(12) United States Patent
Milanova et al.

(10) Patent No.: US 11,701,437 B2
(45) Date of Patent: Jul. 18, 2023

(54) SYSTEMIC DELIVERY OF POLYPEPTIDES

(71) Applicants: President and Fellows of Harvard College, Cambridge, MA (US); Massachusetts Institute of Technology, Cambridge, MA (US); The Brigham and Women's Hospital, Inc., Boston, MA (US); The General Hospital Corporation, Boston, MA (US)

(72) Inventors: Denitsa M. Milanova, Boston, MA (US); George M. Church, Brookline, MA (US); Noah Davidsohn, Brookline, MA (US); Carl Schoellhammer, Medford, MA (US); Robert S. Langer, Newton, MA (US); Anna I. Mandinova, Newton, MA (US); Carlo Giovanni Traverso, Newton, MA (US)

(73) Assignees: President and Fellows of Harvard College, Cambridge, MA (US); Massachusetts Institute of Technology, Cambridge, MA (US); The Brigham and Women's Hospital, Inc., Boston, MA (US); The General Hospital Corporation, Boston, MA (US)

( * ) Notice: Subject to any disclaimer, the term of this patent is extended or adjusted under 35 U.S.C. 154(b) by 760 days.

(21) Appl. No.: 16/612,648

(22) PCT Filed: May 14, 2018

(86) PCT No.: PCT/US2018/032600
§ 371 (c)(1),
(2) Date: Nov. 11, 2019

(87) PCT Pub. No.: WO2018/209359
PCT Pub. Date: Nov. 15, 2018

(65) Prior Publication Data
US 2020/0197538 A1    Jun. 25, 2020

Related U.S. Application Data

(60) Provisional application No. 62/505,308, filed on May 12, 2017.

(51) Int. Cl.
| | | |
|---|---|---|
| A61K 48/00 | (2006.01) | |
| A61K 47/69 | (2017.01) | |
| A61N 7/00 | (2006.01) | |
| C12N 15/86 | (2006.01) | |
| A61K 9/70 | (2006.01) | |

(52) U.S. Cl.
CPC ...... *A61K 48/0075* (2013.01); *A61K 47/6901* (2017.08); *A61N 7/00* (2013.01); *C12N 15/86* (2013.01); *A61K 9/7023* (2013.01); *C12N 2750/14143* (2013.01); *C12N 2750/14145* (2013.01); *C12N 2750/14151* (2013.01); *C12N 2810/859* (2013.01)

(58) Field of Classification Search
None
See application file for complete search history.

(56) References Cited

U.S. PATENT DOCUMENTS

2003/0078499 A1    4/2003   Eppstein
2008/0299182 A1   12/2008  Zhang et al.

FOREIGN PATENT DOCUMENTS

| WO | 2000066149 A1 | 11/2000 | |
| WO | WO-0066179 A1 * | 11/2000 | ......... A61K 38/1774 |
| WO | 2017/015102 A1 | 1/2017 | |

OTHER PUBLICATIONS

Gorell, et al. (2014) "Gene Therapy for Skin Diseases", Cold Spring Harbor Perspectives in Medicine, 4: article e015149, 15 pages long. (Year: 2014).*
Segundo, et al. (2010) "Interferon-Induced Protection against Foot-and-Mouth Disease Virus Infection Correlates with Enhanced Tissue-Specific Innate Immune Cell Infiltration and Interferon-Stimulated Gene Expression", Pathogenesis and Immunity, 84(4): 2063-77. (Year: 2010).*
Wang, et al. (2016) "Nanobody-derived nanobiotechnology tool kits for diverse biomedical and biotechnology applications", International Journal of Nanomedicine, 11: 3287-3303. (Year: 2016).*
Abaitua et al. "Polarized cell migration during cell-to-cell transmission of herpes simplex virus in human skin keratinocytes," J. Virol, May 8, 2013 (May 8, 2013), vol. 87, No. 14, pp. 7921-7932. entire document.
Huang et al. "Isolation of human monoclonal antibodies from peripheral blood B cells," Nat Protoc, Sep. 12, 2013 (Sep. 12, 2013), vol. 8, No. 10, pp. 1907-1915. entire document.
International Search Report and Written Opinion based on PCT/US2018/032600 dated Aug. 23, 2018.
Noel et al. "Skin as a potential organ for ectopic monoclonal antibody production," J Invest Dermatol, Feb. 1, 2002 (Feb. 1, 2002), vol. 118, No. 2, pp. 288-294. entire document.

* cited by examiner

*Primary Examiner* — Robert M Kelly
(74) *Attorney, Agent, or Firm* — Banner & Witcoff, Ltd.

(57) ABSTRACT

A method for the systemic delivery of a polypeptide within a subject is provided by creating genetically modified skin cells via topical introduction of a genetically engineered virus which delivers a nucleic acid encoding a therapeutic polypeptide for expression by the skin cells, wherein the expressed therapeutic polypeptide is secreted by the skin cells and is introduced into the circulatory system of the subject.

34 Claims, 30 Drawing Sheets
(15 of 30 Drawing Sheet(s) Filed in Color)
Specification includes a Sequence Listing.

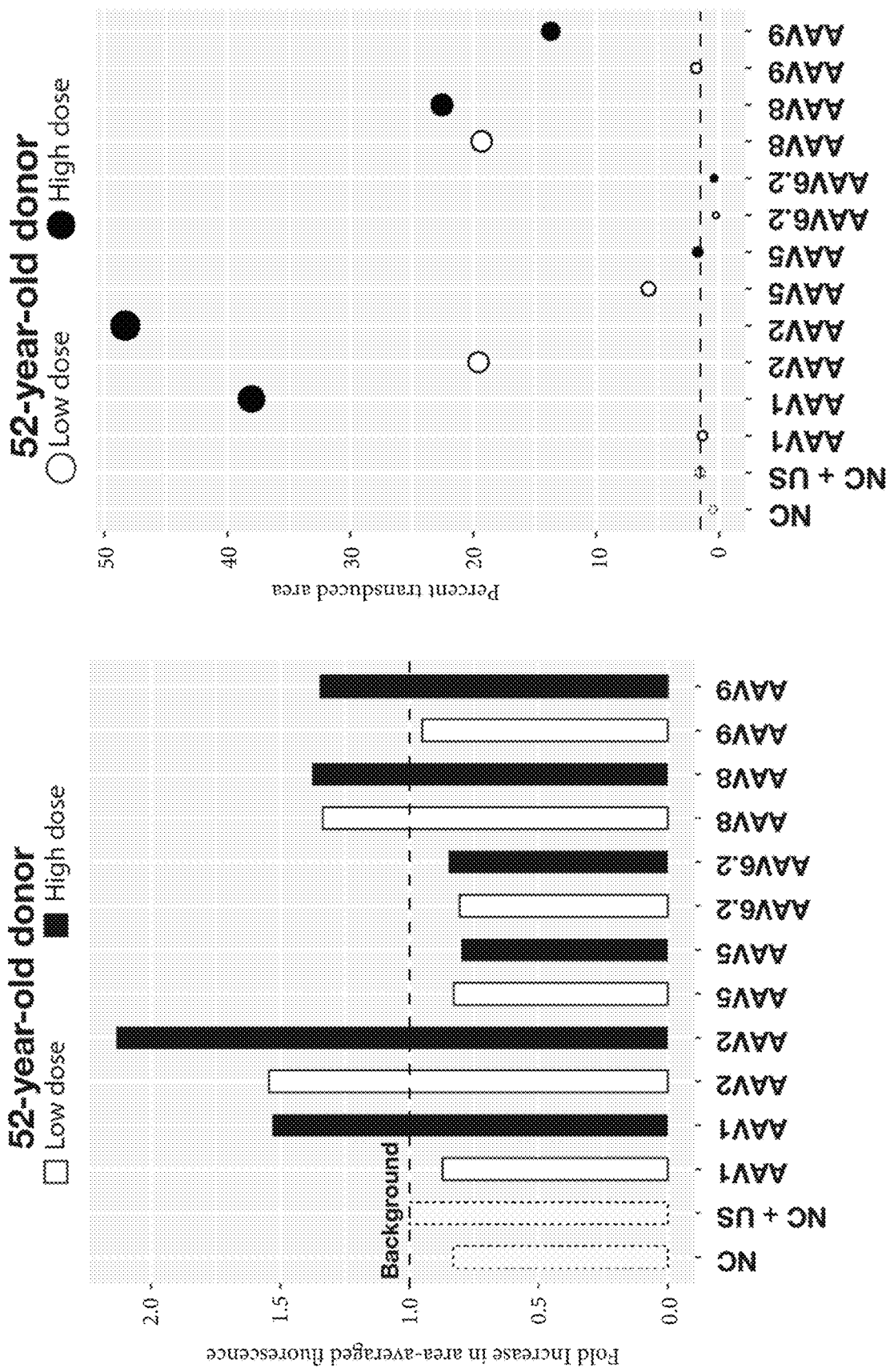

Artificial skin reconstruction

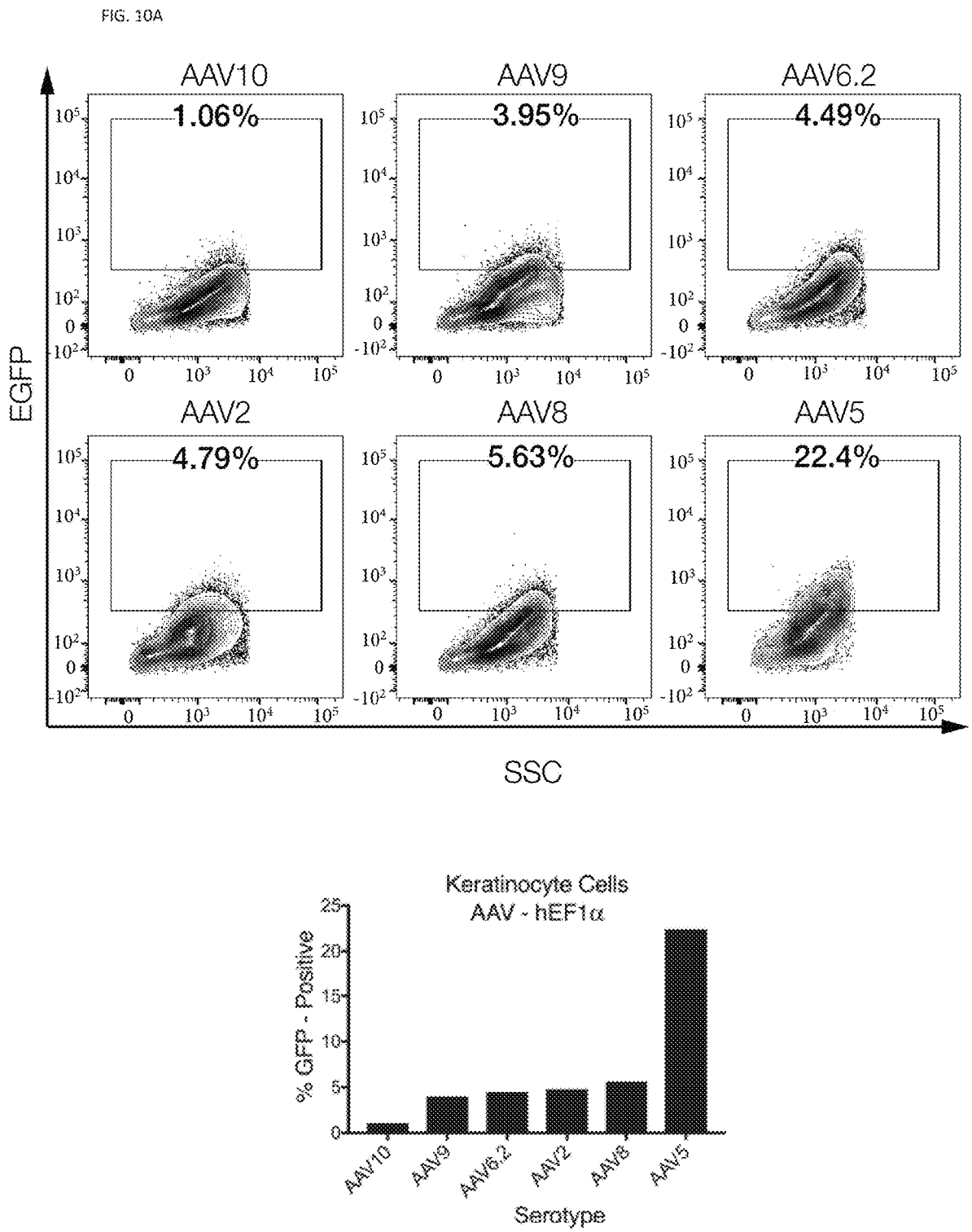

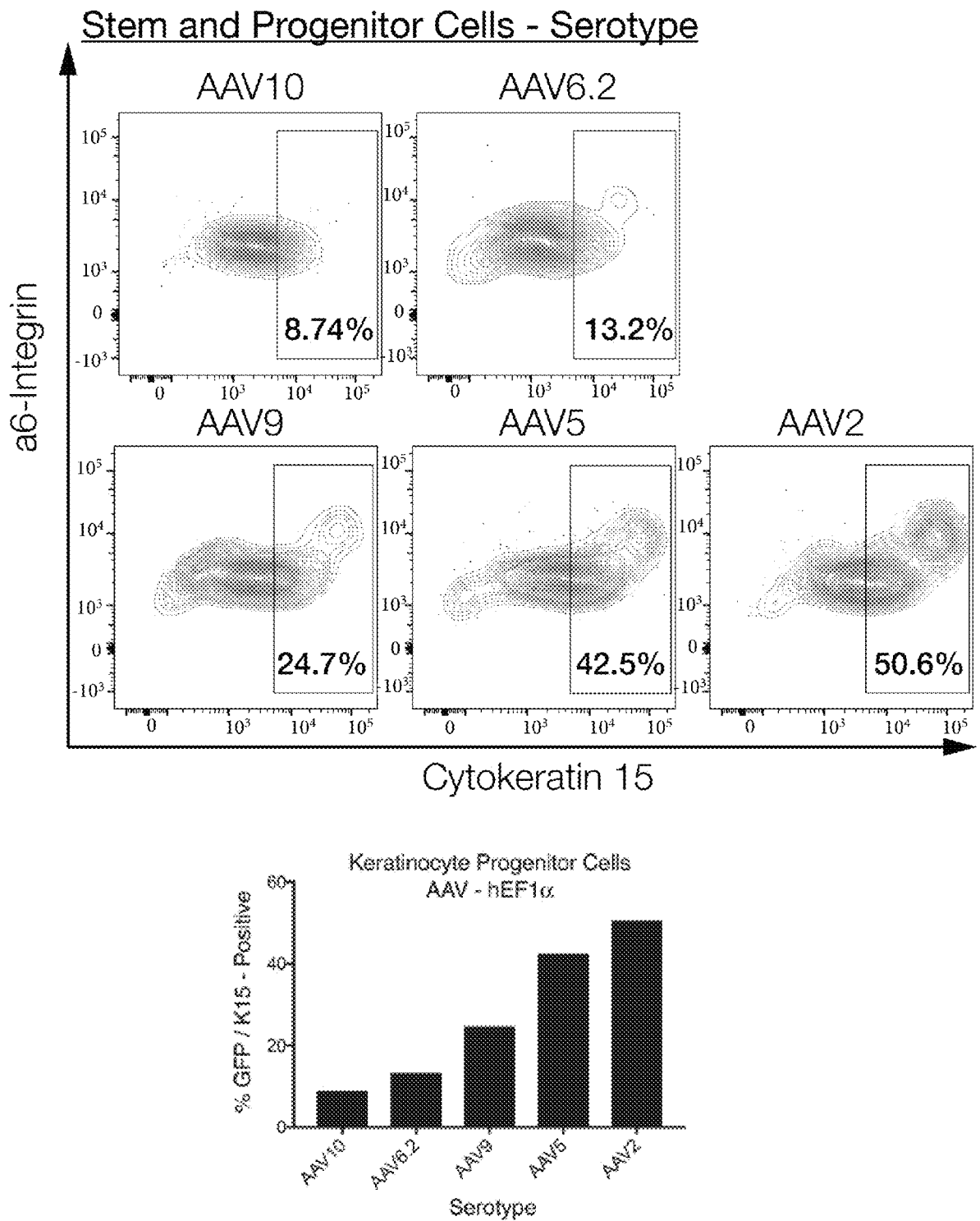

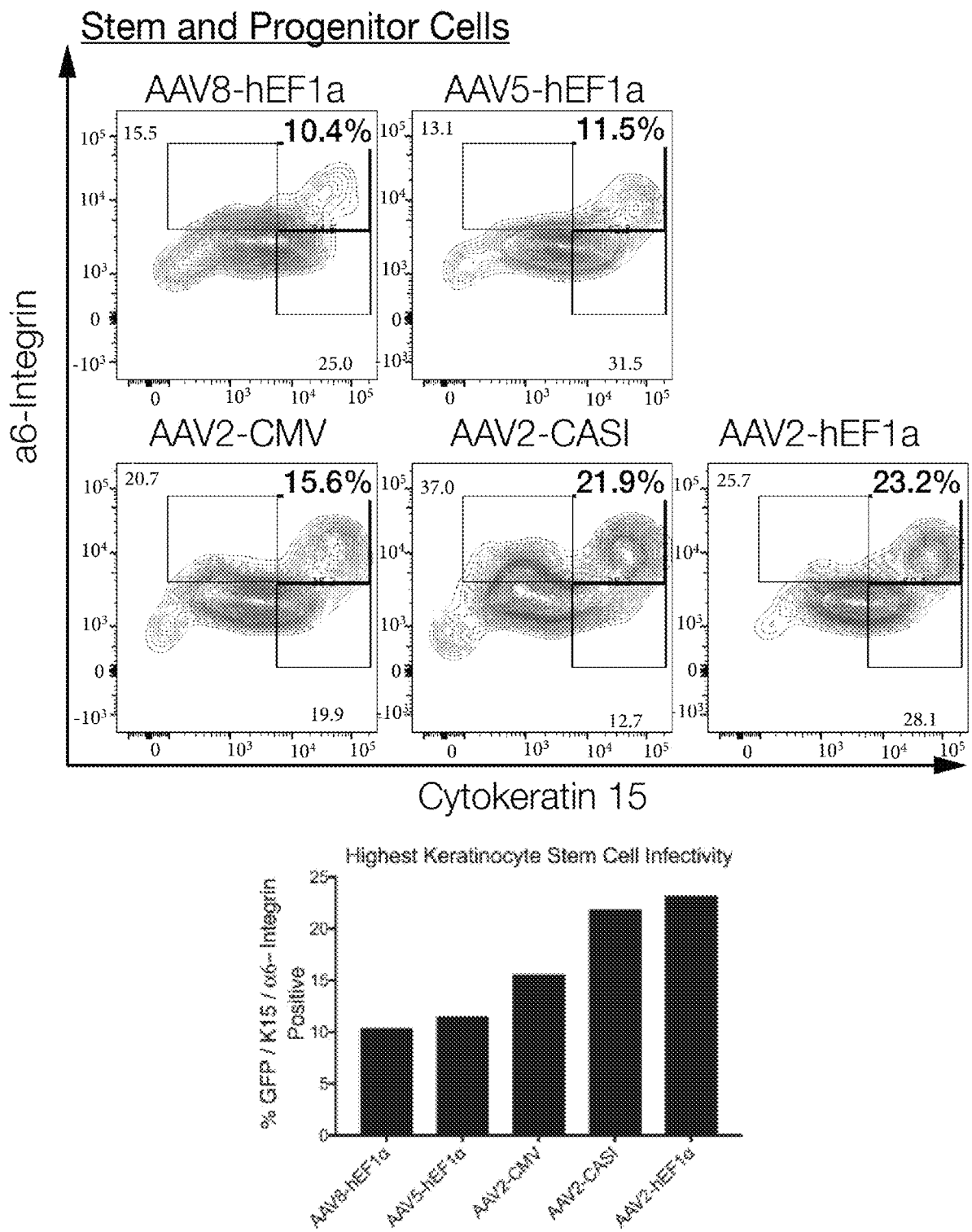

SYSTEMIC DELIVERY OF POLYPEPTIDES

RELATED APPLICATIONS

This application is a National Stage Application under 35 U.S.C. 371 of co-pending PCT application PCT/US18/32600 designating the United States and filed May 14, 2018; which claims the benefit of U.S. provisional application No. 62/505,308 filed on May 12, 2017 each of which are hereby incorporated by reference in their entireties.

STATEMENT OF GOVERNMENT INTERESTS

This invention was made with government support under HG008525, MH113279, and EB000244 from the National Institute of Health. The government has certain rights in the invention.

BACKGROUND

Gene therapy has shown great promise to prevent, treat and cure a variety of diseases and conditions in human and animals. The use of viruses to deliver nucleic acids to cells is generally known. Such viruses may be delivered by invasive methods requiring large doses of the virus. See Xiao, X., Li, J. & Samulski, R. J. Efficient long-term gene transfer into muscle tissue of immunocompetent mice by adeno-associated virus vector. *J Virol* 70, 8098-108 (1996). Such methods are challenging from a therapy or immunization perspective because of delivery efficiency of the nucleic acids to desired tissue in vivo. See Balazs, A. B., Ouyang, Y., Hong, C. M., Chen, J., Nguyen, S. M., Rao, D. S., An, D. S. & Baltimore, D. Vectored immunoprophylaxis protects humanized mice from mucosal HIV transmission. *Nat Med* 20, 296-300 (2014) and Brady, J. M., Baltimore, D. & Balazs, A. B. Antibody gene transfer with adeno-associated viral vectors as a method for HIV prevention. *Immunol Rev* 275, 324-333 (2017). One strategy for passive immunization uses the transcriptional machinery of host muscle cells. See Clark, K. R., Sferra, T. J. & Johnson, P. R. Recombinant adeno-associated viral vectors mediate long-term transgene expression in muscle. *Hum Gene Ther* 8, 659-69 (1997) and Kessler, P. D., Podsakoff, G. M., Chen, X., McQuiston, S. A., Colosi, P. C., Matelis, L. A., Kurtzman, G. J. & Byrne, B. J. Gene delivery skeletal muscle a results in sustained expression and systemic delivery of a therapeutic protein. *Proc Natl Acad Sci USA* 93, 14082-7 (1996). However, there is a continuing need in the art to improve the efficacy of gene therapy.

SUMMARY

Aspects of the present disclosure are based on the use of genetically modified skin cells for the systemic delivery of an agent to a subject. Aspects of the present disclosure are directed to methods of non-invasive delivery of nucleic acid molecules including genes via recombinant viral vectors to skin tissue in vivo of a subject wherein the nucleic acid molecules are expressed and delivered to the circulatory system of the subject.

According to one embodiment, the present disclosure provides a method of systemic delivery of a polypeptide to a subject. In one embodiment, the method includes genetically modifying target skin cells within skin of a subject comprising administering to the subject an engineered virus comprising one or more foreign nucleic acid sequences encoding one or more target polypeptides, wherein the one or more foreign nucleic acid sequences of the engineered virus are introduced into the target skin cells within the skin to produce genetically modified skin cells, and wherein the genetically modified skin cells produce the one or more target polypeptides by expression of the one or more foreign nucleic acid sequences, and wherein the one or more target polypeptides are excreted from the genetically modified skin cells and are introduced systemically within the subject. In certain embodiment, the engineered virus is transmitted in vivo between target skin cells to create additional genetically modified skin cells producing the one or more target polypeptides. In other embodiments the administering the engineered virus comprises topically applying a formulation comprising the engineered virus to skin of the subject. In one embodiment, the genetically modified skin cells are long-lived and non-replicating. In another embodiment, the polypeptide is a therapeutic agent. In one embodiment, the engineered virus is a genetically modified virus. In another embodiment, the engineered virus is a non-integrative viral vector. In one embodiment, the engineered virus is an adeno-associated viral vector. In certain embodiments, the one or more target polypeptides is an antibody or nanobody. In another embodiment, the genetically modified skin cells produce the one or more target polypeptides over a sustained period of time. In one embodiment, the genetically modified skin cells produce the one or more target polypeptides over a sustained period of time to provide immunity against a target disease. In another embodiment, the genetically modified skin cells produce the one or more target polypeptides over a sustained period of time to provide immunity against one or more target antigens. In some embodiments, the one or more target polypeptides are introduced systemically within the subject by introduction into a circulatory system of the subject. In one embodiment, the subject is a mammal. In another embodiment, the subject is a human. In certain embodiments, the skin cells are human skin cells. In one embodiment, the one or more target polypeptides include a neutralizing antibody against HIV-1. In another embodiment, the one or more target polypeptides include a broadly neutralizing antibody against HIV-1. In some embodiments, the one or more target polypeptides include a fibroblast-facilitated neutralizing antibody against HIV-1. In one embodiment, the one or more target polypeptides include a camelid nanobody. In another embodiment, the skin is treated to be permeabilized to the engineered virus. In one embodiment, stratum corneum of the skin is processed to be permeabilized to the engineered virus. In another embodiment, the skin is pretreated with cavitational ultrasound or microdermabrasion to disrupt the cutaneous stratum corneum, and wherein the engineered virus is transported to the epidermis, the papillary and reticulous dermis. In certain embodiments, the skin cells are dermal fibroblast cells or epidermal progenitor cells. In one embodiment, the skin is treated with ultrasound prior to administering the recombinant virus. In another embodiment, the skin is treated with ultrasound prior to administering the recombinant virus and ultrasound is stopped prior to administering the recombinant virus. In one embodiment, the skin is treated with ultrasound at a frequency between about 20 kHz and about 100 kHz. In another embodiment, the skin is treated with ultrasound applied at an intensity between about 1 W cm$^2$ and about 10 W/cm$^2$. In yet another embodiment, the skin is treated with ultrasound applied for a duration between about one minute to about 10 minutes. In still another embodiment, the skin is treated with ultrasound applied at duty cycles in the range of between 25% and 100%. In one embodiment, the skin is treated with ultrasound applied topically or intra-dermally.

In certain embodiments, the engineered virus is a retrovirus, adenovirus, adeno-associated virus (AAV), vaccinia virus or herpes simplex virus. In one embodiment, the engineered virus is a recombinant AAV of serotype 1, 2, 3, 4, 5, 6, 7, 8 or 9. In certain embodiments, the one or more target polypeptides comprises a cytokine including an INF-g or a FGF21. In other embodiments, the one or more target polypeptides comprises a gene including IL-1Ra, HGH, IFN-a, Erythropoietin, Interleukin-2, Factor VIII, or Factor IX. In certain embodiments, the one or more target polypeptides can be a therapy for psoriasis and comprises antibodies against TNFa, IL-12/23, IL-17, or CTLA4-Ig. In other embodiments, the one or more target polypeptides comprisings INF-g which acts as an immure-modulating agent against viral infections, dermatitis, and supplemental agent to cancer treatments.

Further features and advantages of certain embodiments of the present invention will become more fully apparent the following description of embodiments and drawings thereof, and from the claims.

BRIEF DESCRIPTION OF THE DRAWINGS

The patent or application file contains at least one drawing executed in color. Copies of this patent or patent application publication with color drawing(s) will be provided by the Office upon request and payment of the necessary fee. The foregoing and other features and advantages of the present embodiments will be more fully understood from the following detailed description of illustrative embodiments taken in conjunction with the accompanying drawings in which:

FIGS. 3A-D are directed to quantification of expression efficiency. FIGS. 3A and 3C show fold increase in signal intensity relative to the signal of negative control which was treated with ultrasound but no therapy was administered. FIGS. 3B and 3D show percent transduced tissue area in 30-year old (A, B) and 52-year-old (C, D) doctors.

FIG. 4A depicts experimental workflow for in vivo delivery of rAAV2: COL3A1; FIG. 4B depicts a grouped bar plot for Western blot of COL3A1 and ACTB for 2 biological replicates analyzed at 4 times points (at days 0, 12, 20, 28). All data is normalized relative to the protein expression of ACTB. Native content of Collagen III in human skin is taken as reference (normalization) control.

FIG. 6A depicts a three-dimensional organotypic skin tissues recapitulate the stratified structure of the epidermis, the intact basement membrane and the underlying dermis. FIG. 6B depicts protein quantification using Western blot for target genes COL3A1 and housekeeping gene ACTB. In vitro delivery of rAAV2/2: COL3A1 involved skin pretreatment ultrasound, topical delivery of gene therapy; incubation, and harvesting.

FIG. 8A shows a schematic of a length-optimized modular vector with EGFP gene inserted. A typical workflow is shown in FIG. 8B. FIG. 8C shows EGFP gene expression of the transgene in whole skin lysate of Raav viruses of serotypes 2/1, 2/2, 2/5, 2/6.2, 2/7, 2/8, 2/9, and 2/10. FIG. 8D shows the absolute gene expression copy numbers. FIG. 8E shows AAV2:EGFP levels under difference promoters of cytomegalovirus immediate early promoter (CMV), CASI promoter (a fusion of cytomegalovirus immediate early promoter (CMV) followed by a fragment of chicken-f-actin (CAG) promoter), short human elongation factor-1 alpha (shEF1a), and human elongation factor-1 alpha (hEF1a). FIG. 8F shows the expression levels in absolute copy numbers. FIG. 8G shows dose-dependency AAV8:EGFP expression levels in human skin explants. FIG. 8H shows dose-dependency AAV8:EGFP expression levels in absolute copy numbers.

FIG. 9A shows the process for one untreated, one ultrasound-treated, and one AAV-treated tissue sample. A schematic illustration of AAV-CMV-EGFP vector is shown in FIG. 9B. Recombinant AAV viruses of serotypes 2/1, 2/2, 2/5, 2/6.2, 2/8, 2/9 were administered at a dose of 2E+11 GC per tissue explant and the fluorescence signal is reported for two donors, one young (of ages 30) and one old (of age 52) as shown in FIG. 9C. FIG. 9D shows a heatmap illustrating the amount of protein expression in the tissue samples. FIG. 9E shows the results of EGFP expression in populations of single EGFP-positive cells and double EGFP/K15-positive cells.

FIGS. 10A-10C show the results of EGFP expression in keratinocyte cells. FIG. 10A shows EGFP levels in various AAV serotypes. FIG. 10B shows EGFP levels using AAV2/2 at a dose of 2E+11 GC per explant under CMV, CASI, shEF1a, and hEF1a promoters. FIG. 10C shows a dose dependency response using AA8-hEF1a from 5E+10 to 5E+11 GC per explant.

FIGS. 11A-11D show results of long-term expression of genes in skin tissues according to certain embodiments of the disclosure. FIG. 11A shows the differentiated keratinocyte population that was further analyzed for therapy efficacy towards progenitor stem cells expressing markers either for Cytokeratin 15, a6-integrin, or both. Based on their ability to infect progenitor and stems cells, the top 5 most efficacious AAV-serotypes measured by GFP and K15 signal are listed in FIG. 11B. FIG. 11C shows results of expression of K15 and a6-integrin using various AAV vectors. FIG. 11D shows the results of the correlation of infection towards epidermal stem and progenitor cells.

FIG. 12A shows a schematic diagram of fibroblast growth factor 21 (FGF21) expression construct. FIG. 12B shows mouse cytokine levels in medium cultured human explants.

FIG. 13A shows a schematic workflow for in vivo gene transfer to mouse skin. FIG. 13B shows results of mouse FGF21 expression levels in hairless mouse skin.

FIG. 14A shows a schematic diagram of the process by which immune-modulating molecules are made by the skin's bio-machinery according to certain embodiments of the disclosure. FIG. 14B shows a schematic diagram of a recombinant AAV2/2 virus expression construct of an unmodified sequence for human INFG gene according to an embodiment of the disclosure. FIG. 14C shows systemic cytokine levels in SKH-1E mice.

FIG. 15A shows a schematic diagram of the used vector for expression of VRC01 bnAb according to an embodiment of the disclosure. FIG. 15B shows the results of systemic IgG levels in SKH-1E mice.

FIG. 16A shows results of high VP protein purity. FIG. 16B shows an image of the virus under the transmission electron microscopy.

DETAILED DESCRIPTION

Figure 1:
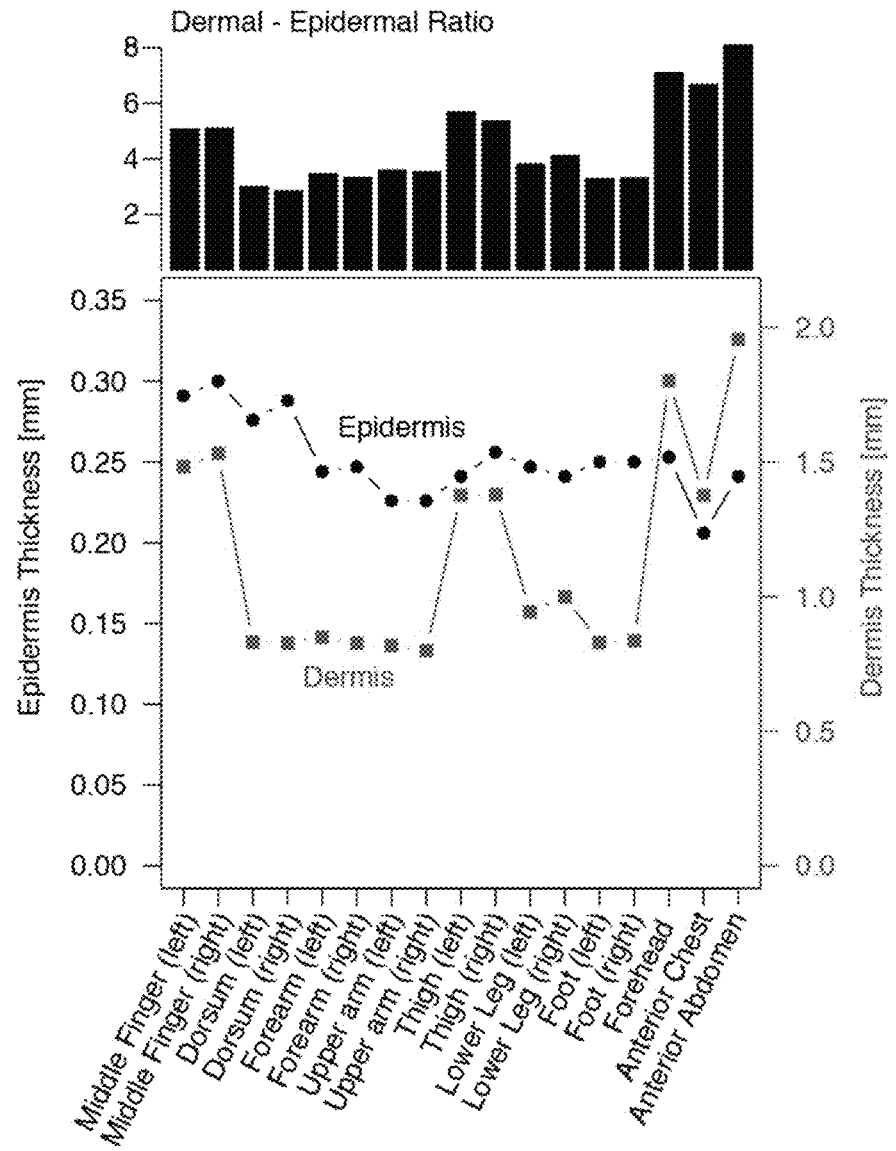
FIG. 1 is directed to measurements of skin thickness. Epidermal and dermal thicknesses measured with high-frequency ultrasound are plotted for 17 anatomical sites (matched to those in the modified Rodnan skin score) on the human body in 34 healthy patients. As a measure of inverse correlation of epidermal and dermal thicknesses, dermal-to-epidermal ratio (DER) is reported by a single score on a bar plot (top of the figure). High scores represent thick dermal/thin epidermal thicknesses, while low scores represent thin dermal/thick epidermal thicknesses. Based on these results, we have selected top candidates for delivery location, which are anterior abdomen, forehead, anterior chest, and thigh, in descending order. We further filter the data and select our top two candidates based on the location of the anatomic site—anterior abdomen and thigh, because those two are the closest to the small pelvis where primary infections take place.

Embodiments of the present disclosure are directed to methods of delivering nucleic acid molecules of interest via recombinant viruses to a skin tissue. The present disclosure describes a method of systemic delivery of an agent, such as a polypeptide, to a subject including genetically modifying target skin cells within skin of a subject using an engineered virus. The engineered virus includes one or more viral genomic nucleic acid sequences and one or more foreign nucleic acid sequences encoding one or more target polypeptides. The one or more viral genomic nucleic acid sequences and the one or more foreign nucleic acid sequences encoding one or more target polypeptides are introduced into the target skin cells to produce genetically modified target skin cells. The genetically modified target skin cells produce the one or more target polypeptides. The one or more target polypeptides are excreted from the genetically modified skin cells and is introduced systemically within the subject via the bloodstream. According to one aspect, the genetically modified target skin cells may contain the genetic elements to also produce the engineered virus which replicates intradermally between target cells. In this manner, engineered virus carrying the one or more foreign nucleic acid sequences encoding one or more target polypeptides is transmitted in vivo between target skin cells to create additional genetically modified skin cells producing the target polypeptide. The target polypeptide is excreted from the genetically modified skin cells and is introduced systemically within the subject via the bloodstream.

According to one aspect, an engineered virus is administered to the skin of the subject in a manner to direct the engineered virus to the target skin cells. Various administration methods are contemplated including topical application to skin and other methods known to those of skill in the art and as described herein.

According to one aspect, the skin of the subject may be treated so as to permeabilize the stratum corneum of the skin to the presence of the engineered virus or otherwise improve efficiency of the engineered virus to traverse the stratum corneum to the target skin cells. After treating the skin surface, the engineered virus may be administered to the skin surface, such as by topical administration, and the engineered virus may be directed to or passively diffuse to the target skin cells whereupon the engineered virus infects the target cells to include the one or more nucleic acid sequences encoding one or more target polypeptides. Accordingly, in exemplary embodiments, methods described herein include two major steps. In step one, ultrasound is applied to a skin tissue to increase tissue permeation. In step two, recombinant viruses carrying foreign nucleic acid molecule(s)/gene(s) of interests are delivered to the skin cells. The virus replicates to other cells within a target cell population using a viral replication mechanism so as to intradermally provide target cells with one or more nucleic acid sequences encoding one or more target polypeptides. The one or more target polypeptides are produced by the genetically modified target cells and the one or more target polypeptides are excreted from the genetically modified target cells and into the blood stream of the subject, so as to provide a systemic administration of the one or more target polypeptides. According to one aspect, the one or more target polypeptides are excreted from the genetically modified target cells in a manner to provide a prolonged release of the one or more target polypeptides into the bloodstream of the subject. Embodiments of the present disclosure are directed to a method of delivering a recombinant virus to a skin tissue including applying ultrasound to the skin tissue, and administering the recombinant virus to the skin tissue. According to one aspect, the recombinant virus is delivered to the skin tissue of a subject in vivo.

According to one aspect, a delivery platform is provided that utilizes a subject's skin, such as mammalian skin, to enable a single-step, extended production (such as year-long production) of biologics wherein polypeptide-encoded vectors (such as gene-encoded vectors) are topically administered to skin in a non-invasive manner so as to treat or prevent a disease. Skin cells are provided with non-integrative viral vectors which, according to one embodiment, may lack specific cytotoxicity and pathogenicity. According to one aspect, delivery of the viral vectors is achieved by noninvasive or "needleless" methods. Such noninvasive or "needleless" methods may also include breakage of the stratum corneum using methods described herein or which become apparent based on the present disclosure. The protective skin layer known as the stratum corneum is disrupted so as to provide entry sites through the stratum corneum to cells below the stratum corneum. The cells are to be genetically modified by viral infection. The genetic modification of skin cells to include the gene-encoded vectors provides for long-lived and efficient translation of a polypeptide, such as a therapeutic agent, such as neutralizing antibodies, in vivo to provide a safe and effective gene transfer for treatment or prevention, such as HIV immunoprophylaxis.

According to one aspect, skin is pretreated using noninvasive technology, such as ultrasound or microdermabrasion, to permeabilize or score or remove the stratum corneum. The engineered virus, such as an antibody-encoding adeno-associated virus ("AAV particles") is administered to the skin or otherwise delivered to the skin, which may be a section of skin near active lymph nodes. According to one aspect, target cells (such as dermal fibroblasts) endosome, the AAV particles and the AAV particles release the DNA contained therein into the fibroblast cell nucleus. The fibroblast cells translate and secrete the one or more polypeptides to the blood stream. The polypeptides are present within the blood system for therapy or prevention. For example, the one or more polypeptides may be broadly neutralizing antibodies present within the blood system to prevent infection. In this manner, the skin may be transformed into an in vivo bioreactor for the production of biologics, such as antibodies, for transfer into the blood stream.

Subjects and Target Cells

According to one aspect, the methods are carried out on a subject which may be a human or non-human mammal. The non-human mammal may be a mouse, rat, cow, pig, sheep, goat, horse, dog or cat.

According to one aspect, the methods are carried out on skin as described herein and the vectors or viral vectors are transmitted to skin cells as described herein as target skin cells. Different skin layers, structures and cells can be targeted for nucleic acid or gene delivery according to certain embodiments of the disclosed methods. The skin is composed of diverse cells derived from three distinct embryonic origins: neurectoderm, mesoderm, and neural crest. Recombinant viral vectors can be delivered to one or more of the three layers of the skin: the epidermis, dermis, and hypodermis. The epidermis, the outermost layer, is primarily composed of stratified squamous epithelium of keratinocytes, which is derived from neurectoderm and comprises over ninety percent of epidermal cells. The stratified squamous epithelium is further divided into four layers, starting with the outermost layer: stratum corneum (SC), stratum granulosum (SG), stratum spinosum (SS), and stratum basale (SB). Cells of the epidermis including keratinocytes which are responsible for the cohesion of the epidermal structure and the barrier function, pigment-containing melanocytes, antigen-processing Langerhans cells, and pressure-sensing Merkel cells can be targeted by the viral vectors.

The dermis is a connective tissue that is responsible for the mechanical properties of the skin. It is composed of fibroblasts of mesoderm origin, which lie within an extracellular specialized matrix. Collagens are interwoven with elastin, proteoglycans, fibronectin, and other components. The epidermis and dermis are connected by a basement membrane that is composed of various integrins, laminins, collagens, and other proteins that play important roles in regulating epithelial-mesenchymal cross-talk. The superficial papillary dermis is arranged in ridge-like structures called the dermal papillae, which contains microvascular and neural networks and extends the surface area for these epithelial-mesenchymal interactions. Sebaceous glands, eccrine glands, apocrine glands and hair follicles are of neurectoderm origin and develop as downgrowths of the epidermis into the dermis. Outer root sheath of the hair follicle is contiguous with the basal epidermal layer. In addition, the dermis also contains blood vessels and lymphatic vessels of mesoderm origin, and sensory nerve endings of neural crest origin. The hypodermis, which is deep to the dermis, is composed primarily of adipose tissue of mesoderm origin, and separates the dermis from the underlying muscular fascia. Vectors and viral vectors can also target these cells, glands, and structures of the dermis and hypodermis as described above.

Recombinant viral vectors can also target skin-specific stem cells which possess the ability for skin tissue to self-renew. Multipotent or unipotent skin stem cells are slowly-cycling cells that reside in at least five distinct niches in the skin: basal (innermost) layer of epidermis, hair follicle bulge, base of sebaceous gland, dermal papillae, and dermis. Not only are these stem cells critical for the long-term maintenance of the skin tissue but also are activated by wounding to proliferate and regenerate the tissue. Skin specific resident T cells are also target skin cells within the present disclosure. Skin-specific stem cells include hair follicle stem cells for hair follicle and continual hair regeneration, melanocyte stem cells giving rise to the melanocytes in both the hair matrix and epidermis, stem cells at the base of the sebaceous gland for continually generating terminally differentiated sebocytes, which degenerate to release lipids and sebum through the hair canal and lubricate the skin surface, mesenchymal stem cells that giving rise to fibroblasts, nerves and adipocytes, and a skin-derived precursor stem cell (SKP) distinct from mesenchymal stem cells.

It is to be understood that the basic concepts of the present disclosure described herein are not limited by cell type. For example, target skin cells include cell types around hair follicles as the method may be applied to haired regions for delivery as the vectors or viral vectors may more easily penetrate through such skin areas. In another instance, melanocytes can be targeted for delivery of a therapeutic or prophylactic agent as in the case for melanoma. In yet another instance, immune cells (Langerhans cells) can be targeted for delivery of a therapeutic or prophylactic agent, as in an acute infections. It is to be understood that more than one cell type can be targeted at the same time by using a mixture of hybrid AAVs directed to each cell type in a plurality of cell types, such as to be administered in one cocktail formulation where it is desired to enhance efficiency of infectivity and achieve broad tropism.

According to one aspect, the target cells described herein may be skin cells. According to one aspect, the skin cells are in vivo, in vitro or ex vivo. Exemplary target skin cells are dermal fibroblasts. According to one aspect, the skin cells are mammalian skin cells. Mammals include, but are not limited to murines, simians, humans, farm animals, sport animals, and pets. Tissues, cells and their progeny of a biological entity obtained in vivo or cultured in vitro are also encompassed. According to one aspect, the skin cells are human skin cells. According to one aspect, the target cells are present in sufficient number so as to produce a sufficient amount of the target polypeptide to provide a sufficient concentration of the target polypeptide within the blood of a subject so as to provide therapeutic treatment or preventative treatment. Dermal fibroblasts account for a total of $2.6 \times 10^{10}$ cells at an average surface density of $1.3 \times 10^6$ cells/cm$^2$. Dermal fibroblasts are relatively transcriptionally uncommitted and they have long cell cycle of about 54-60 days. Dermal fibroblasts produce monoclonal antibodies upon retroviral gene transfer in vitro (see Noel, D., Pelegrin, M., Brockly, F., Lund, A. H. & Piechaczyk, M. Sustained systemic delivery of monoclonal antibodies by genetically modified skin fibroblasts. *J Invest Dermatol* 115, 740-5 (2000) hereby incorporated by reference in its entirety) and in skin grafts in immunocompetent mice (see Noel, D., Dazard, J. E., Pelegrin, M., Jacquet, C. & Piechaczyk, M. Skin as a potential organ for ectopic monoclonal antibody production. *J Invest Dermatol* 118, 288-94 (2002) hereby incorporated by reference in its entirety). Exemplary target skin cells are present in a sufficient amount, are relatively transcriptionally uncommitted and have long cell cycle. Target cells can also include any skip cell having the characteristics described above, such as epidermal progenitors. See Khavari, P. A., Rollman, O. &. Vahlquist, A. Cutaneous gene transfer for skin and systemic diseases. *J Intern Med* 252, 1-10 (2002) hereby incorporated by reference in its entirety.

According to one aspect, a skin surface area and skin location for administration of engineered viruses to result in a sufficient production of a target polypeptide is determined. For calculations of fibroblast translational capacity and necessary surface area of transduction, estimations for cell densities in the two dermal layers: papillary dermis, occupying ~10% of the total dermal thickness, and reticular dermis—the rest, 90% are used. See Sender, R., Fuchs, S. & Milo, R. Revised Estimates for the Number of Human and Bacteria Cells in the Body. *PLoS Biol* 14, e1002533 (2016) hereby incorporated by reference in its entirety. Due to variations in cell density as a function of dermal depth, the cell surface density is two orders larger in the papillary dermis versus that in the reticular dermis. An exemplary surface skin area for the transduction of $10^8$ cells (previously reported to output 10 μg/mL in mouse serum) at 50% efficiency is about 142 $cm^2$, or a patch of about 12 cm by 12 cm in a 100-kilogram individual. It to be understood that the estimates of cell number to provide an output of 10 μg/mL monoclonal antibody serum levels may be based on empirical observations of genetically modified fibroblasts embedded in artificial matrices before implantation in vivo. Therefore, estimates are not exact predictions but rather, useful, though rough order-of-magnitude estimates of an exemplary upper bound constraint for cell number and area requirement. One of skill will readily be able to determine suitable surface areas for delivery of various concentrations of agents, such as polypeptides, into the circulatory system or other system suitable for systemic administration of a therapeutic or prophylactic agent, such as a polypeptide known in the art to be suitable for treatment or preventative methods. Such therapeutic or prophylactic agents useful in the methods described herein are readily identifiable based on the present disclosure.

According to the present disclosure, secretion capacity may be assessed ex vivo. Production efficiency is tested in human skin explants taken from patients' anatomical sites characterized with thick dermis and thin epidermis at doses and surface as necessary to achieve ~10-100 μg/mL (an optimal concentration to translate to ~1 μg/mL in human in vivo). Dermal-epidermal ratios (DERs) are high for anterior abdomen, forehead, anterior chest, and thigh in human skin. (see FIG. 1). According to one aspect, an exemplary anatomical site for engineered virus administration is near the small pelvis, is highly vascularized and is in close proximity to active lymphatics. An exemplary anatomical site is anterior abdomen (with a score of DER=8.1), or thigh (of DER=5.7). According to one aspect, dermal fibroblasts in living skin of the anterior abdomen are targeted with non-integrative viral vectors encoding neutralizing antibodies with high efficiency and long temporal secretion to the blood stream.

Plasmids, Vectors and Viral Vectors

Vectors are contemplated for use with the methods and constructs described herein. The term "vector" includes a nucleic acid molecule capable of transporting another nucleic acid to which it has been linked. Vectors used to deliver the nucleic acids to cells as described herein include vectors known to those of skill in the art and used for such purposes. Certain exemplary vectors may be plasmids, lentiviruses or adeno-associated viruses known to those of skill in the art. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. retroviruses, lentiviruses, replication defective retroviruses, adenoviruses, replication defective adenoviruses, and adeno-associated viruses). Viral vectors also de polynucleotides carried by a virus for transfection into a host cell. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors." Common expression vectors of utility in recombinant DNA techniques are often in the form of plasmids. Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" or "operatively linked" is intended to mean that the nucleotide sequence of interest is linked to the regulatory element(s) in a manner that allows for expression of the nucleotide sequence (e.g. in an in vitro transcription/translation system or in a host cell when the vector is introduced into the host cell). Vectors according to the present disclosure include those known in the art as being useful in delivering genetic material into a cell and would include regulators, promoters, nuclear localization signals (NLS), start codons, stop codons, a transgene etc., and any other genetic elements useful for integration and expression, as are known to those of skill in the art.

Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA is packaged in a cell line, which contains a helper plasmid encoding the other AAV genes, namely rep and cap, but lacking ITR sequences. However, it is to be understood that useful viral vectors may also include the genetic sequences for replication and the capsid, when it is desired that the virus be replicated and transmitted from cell to cell. In such a method, the virus replicates and transmits the one or more foreign nucleic acid sequences from cell to cell for expression.

According to one aspect, methods described herein may use a viral plasmid without the capsid. Such a viral plasmid is referred to in the art as a naked viral plasmid. That is, the viral plasmid will have the ITR regions and all nucleic acid sequence elements required for transcription but delivered naked without the capsid.

According to one aspect, viral vectors may be selected based on the ability to target cell types in a specific manner. According to one aspect, exemplary viruses may be identified based on the parameters described herein. The use of recombinant RNA or DNA viral based vector systems for the delivery of nucleic acids takes advantage of highly evolved processes for targeting a virus to specific cells in the skin tissue and trafficking the viral payload to the nucleus. According to certain embodiments, recombinant viral vectors can be administered directly to the skin of a subject (in vivo) or they can be administered to skin tissues or cells in vitro, and skin tissues or cells that were modified by the recombinant viruses may optionally be grafted or administered back to the subject (ex vivo). Conventional recombinant viral based vector systems can include retroviral, lentivirus, adenoviral, adeno-associated virus (AAV), vaccinia virus and herpes simplex virus vectors for gene transfer. Of these viral vectors, recombinant AAV is thought to be the safest due to its lack of pathogenicity. Integration in the host genome is possible with the retrovirus, lentivirus, and adeno-associated virus gene transfer methods, often resulting in long term expression of the inserted transgene. Additionally, high transduction efficiencies using these recombinant viruses have been observed in many different cell types and target tissues. In certain embodiments, following ultrasound treatment of the skin, rAAV vectors containing genes of interest are topically applied to the skin tissue and let passively diffuse to reach skin cells in both epidermal and dermal skin layers. The tropism of an AAV can be altered by different capsid proteins. A skilled in the art can select appropriate rAAV serotype, including serotypes 1-9 based on the tropism for a particular cell type.

According to one aspect, rAAV vectors or particles are utilized which lack the capability to replicate, i.e., they are nonreplicating. Such AAV vectors are known to those of skill in the art for delivering a payload nucleic acid sequence. Such vectors or particles are delivered to a cell. For example, one or more AAV particles are delivered per cell, where an exemplary infectivity ratio is typically 100:1 virus to cell, and is dose-dependent. Once infected by the virus, the cell has machinery to transcribe the viral DNA (which is circular double stranded DNA) encoding for a target therapeutic agent or prophylactic agent known to those of skill in the art and which may be referred to as a payload. An exemplary payload is an antibody. The infected cell has the cellular machinery to properly make the antibody which is then secreted to the blood stream and then the lymphatics. According to one aspect, a replicating virus may be used in gene therapy methods described herein. Such an approach utilizes a molecular switch for activating and/or deactivating the replication capability of the virus. Both nonreplicating and replicating viruses are used as treatment or prophylaxis for various conditions, ranging from immunotherapy in cancer, autoimmune diseases whose treatment require monoclonal antibodies, to infectious diseases where passive production of antibodies enables immunity.

Exemplary viral vectors may be identified by multiplexed screening of hybrid capsid variations of adeno-associated viruses ("AAVs"). Hybrid AAV constructs typically exhibit less immunogenicity than the wild-type AAV, and have greater tissue specificity.

A large set of existing viral serotypes is optimized, synthesized and tested in human organotypic cultures. Human abdominal skin is cultured ex vivo, using native fluorescence of reporter genes, FACS, and in situ screening approaches. The method is high-throughput, allows for combinatorial optimization, and accounts for donor-to-donor variability related to immune response and metabolic state. According to one aspect, a human skin explant model is utilized that preserves the physiological complexity, the proliferative capacity and the structural integrity of all skin components for up to 28 days. See Frade, M. A., Andrade, T. A., Aguiar, A. F., Guedes, F. A., Leite, M. N., Passos, W. R., Coelho, E. B. & Das, P. K. Prolonged viability of human organotypic skin explant in culture method (hOSEC). *An Bras Dermatol* 90, 347-50 (2015); Manevski, N., Swart, P., Balavenkatraman, K. K., Bertschi, B., Camenisch, G., Kretz, O., Schiller, H., Walles, M., Ling, B., Wettstein, R., Schaefer, D. J., Itin, P., Ashton-Chess, J., Pognan, F., Wolf, A. & Litherland, K. Phase II metabolism in human skin: skin explants show full coverage for glucuronidation, sulfation, N-acetylation, catechol methylation, and glutathione conjugation. *Drug Metab Dispos* 43, 126-39 (2015); and Xu, W., Jong Hong, S., Jia, S., Zhao, Y., Galiano, R. D. & Mustoe, T. A. Application of a partial-thickness human ex vivo skin culture model in cutaneous wound healing study. *Lab Invest* 92, 584-99 (2012) each of which are hereby incorporated by reference in its entirety. Viable explants are utilized with a surface area of 15-20 mm to enable topical treatment with test agents and compositions. See Kolev, V., Mandinova, A., Guinea-Viniegra, J., Hu, B., Lefort, K., Lambertini, C., Neel., V., Dummer, R., Wagner, E. F. & Dotto, G. P. EGFR signalling as a negative regulator of Notch1 gene transcription and function in proliferating keratinocytes and cancer. *Nat Cell Biol* 10, 902-11 (2008) and Neel, V. A., Todorova, K., Wang, J., Kwon, E., Kang, M., Liu, Q., Gray, N., Lee, S. W. & Mandinova, A. Sustained Akt Activity Is Required to Maintain Cell Viability in Seborrheic Keratosis, a Benign Epithelial Tumor. *J Invest Dermatol* 136, 696-705(2016) each of which are hereby incorporated by reference in its entirety.

Figure 2:
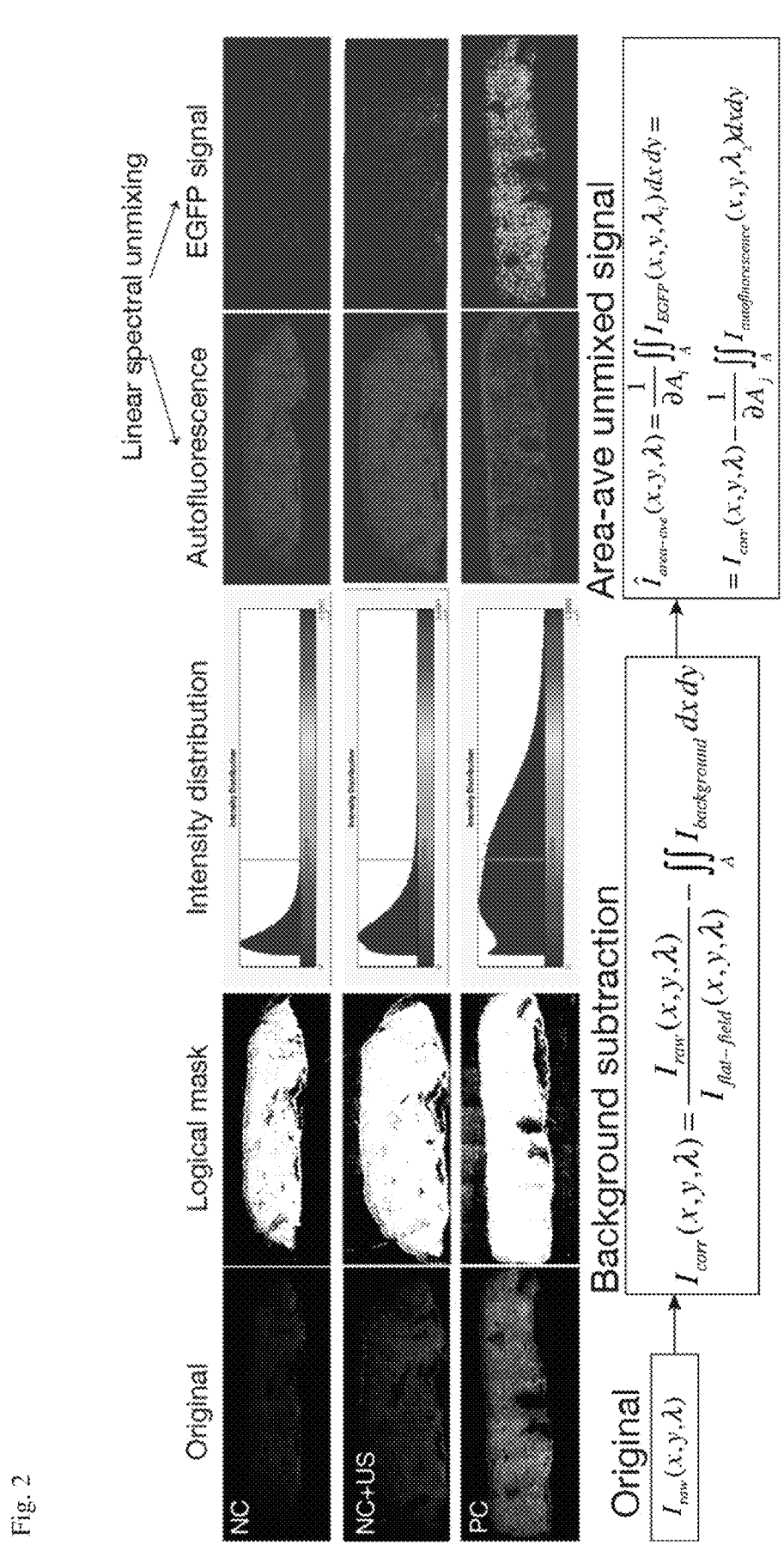
FIG. 2 is directed to an image processing algorithm and an approach for estimating native EGFP fluorescence in large skin tissue sections.
Figure 3A:
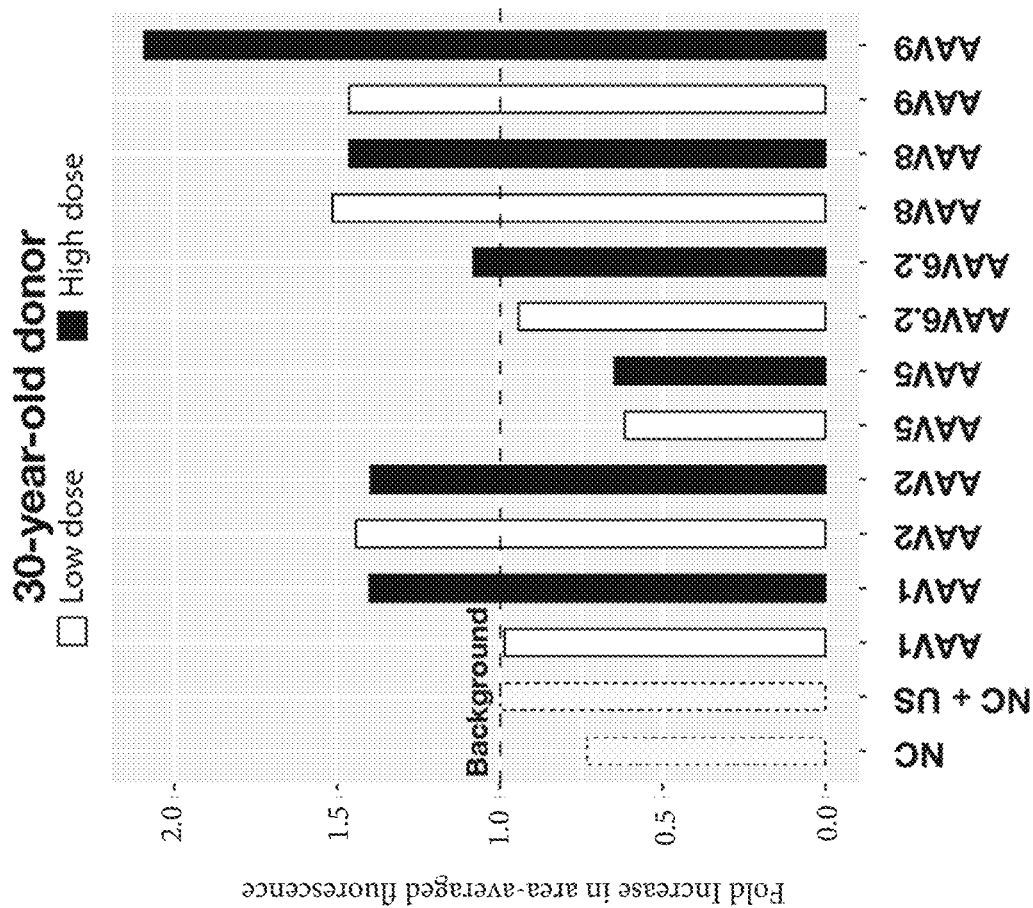
Figure 3B:
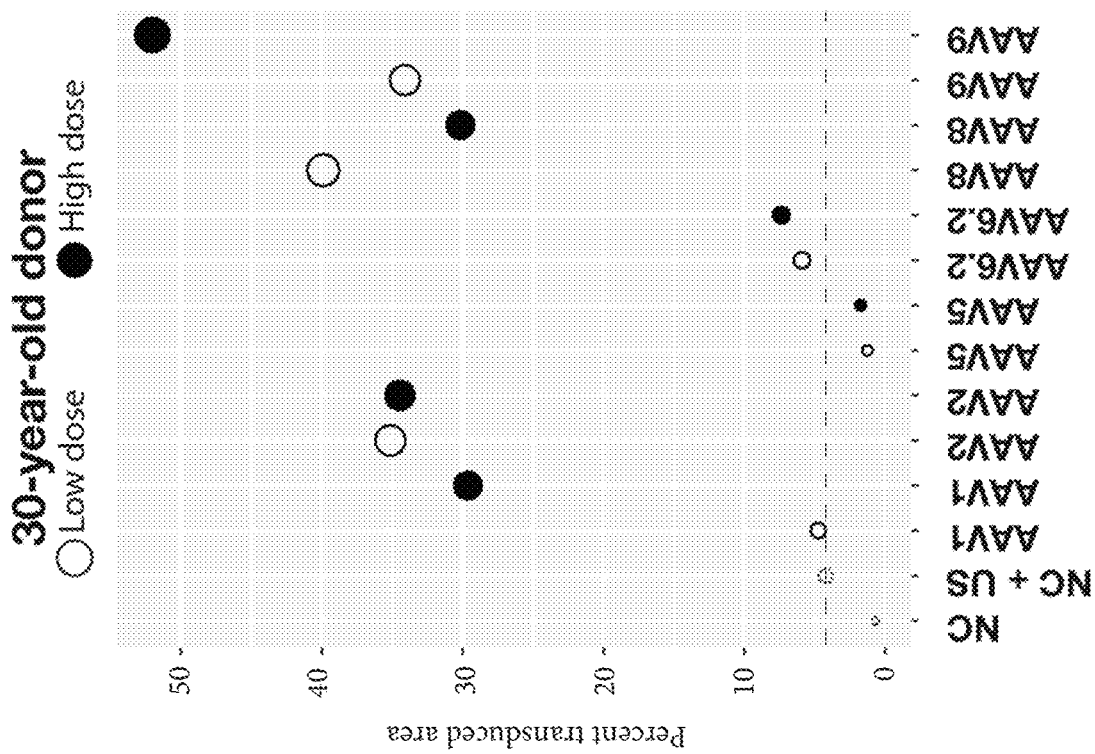
Figure 4B:
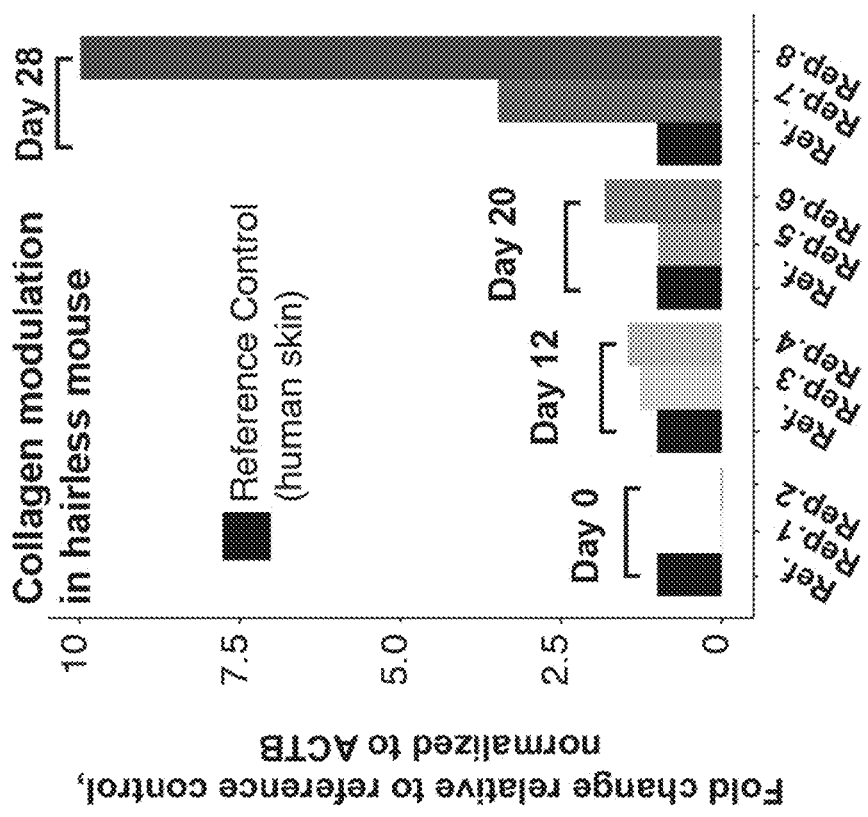
FIGS. 4A-B are directed to a demonstration of skin gene therapy in vivo.
Figure 4A:
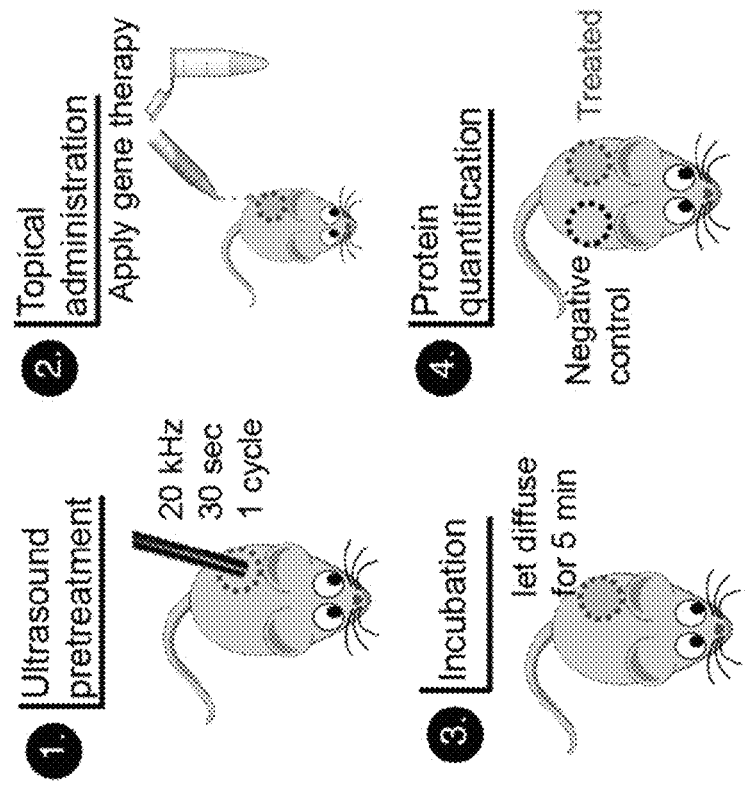
Figure 5:
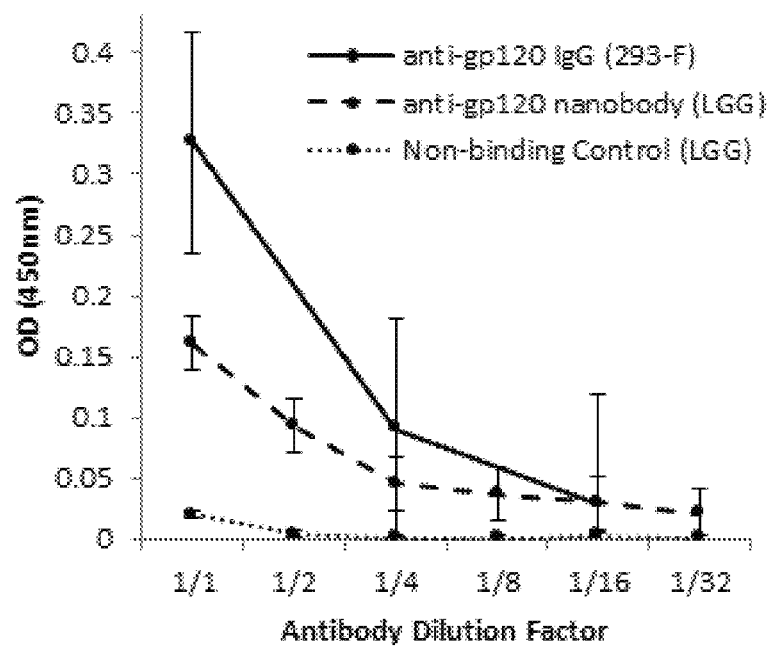
FIG. 5 depicts data for gp120 ELISA [Undiluted IgG]=4 ng/mL; [Undiluted Nanobody]≤5 ng/mL.
Figure 6A:
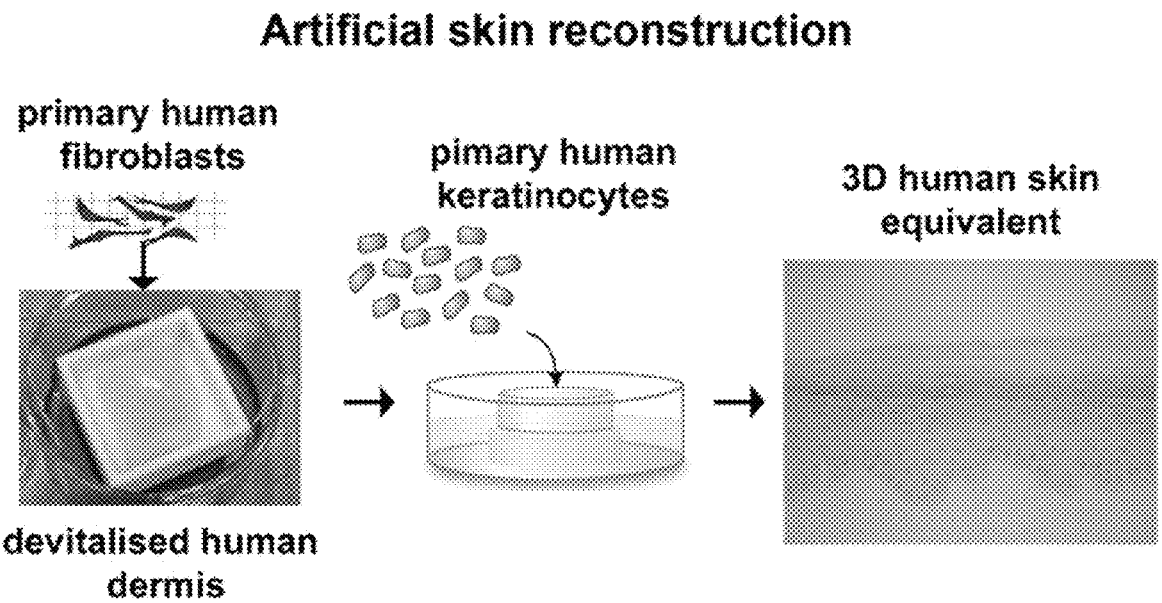
FIGS. 6A-B depicts in vitro model of tissues made of primary human cultures.
Figure 6B:
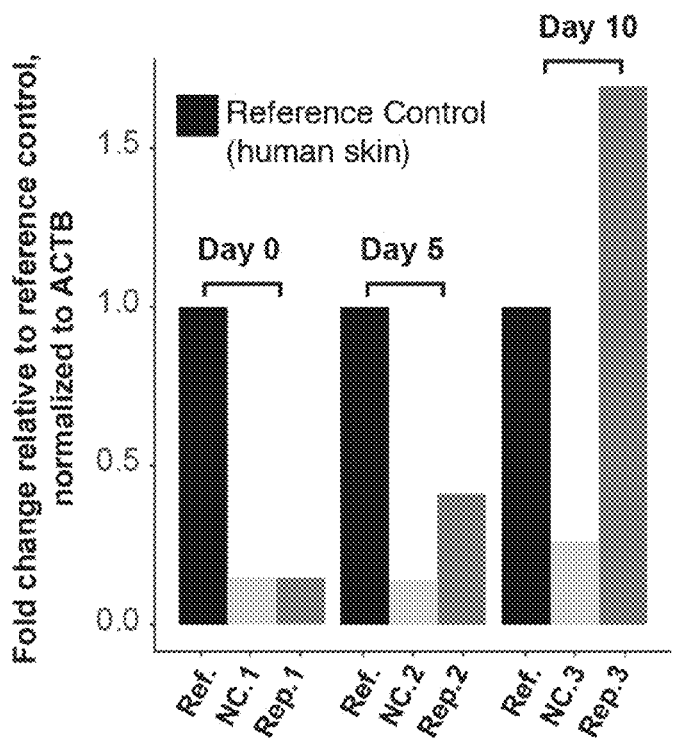

According to one aspect, rAAV vector serotypes exhibit tissue specificity and efficiency of gene transfer. To establish delivery efficiency, the native fluorescence was studied of a reporter gene (rAAV: EGFP) distributed over a large surface area in full thickness human (breast) skin tissues (16 mm×2 mm in cross-sectional area) maintained in a culture dish for 24 hours, post-treatment. To enable quantification, the native fluorescence was studied of a reporter gene distributed over a large surface area in full thickness human (breast) skin tissues cultured for 24 hours post-treatment. The signal of EGFP in frozen samples (16 mm×1 mm×20 µm) was analyzed and quantified using a custom MatLab code for image post-processing. This algorithm executes flat-field and background corrections and creates a logical mask of the image. Based on the different emission spectra of tissue auto-fluorescence and signal due to the expression of EGFP, the algorithm performs linear un-mixing of the total fluorescence intensity. Finally, it identified the areas of these unmixed signals. FIG. 2 depicts one negative, one negative ultrasound-treated, and one positive control. In two donors of ages 30 and 52, signal intensities (FIGS. 3A, 3C) and percent transduced tissue areas (FIGS. 3B, 3D) are provided for wild type rAAV2: EGFP, and hybrid constructs encoding for the rep gene from AAV2 and cap gene derived from serotypes AAV1, AAV5, AAV6.2, AAV8, and AAV9. Cell tropism of these hybrid viruses and wild-type AAV2 considerably differs in whole skin tissues and certain viral capsids displayed successful transductions. Up to 2.1-fold enhancement in the expression of EGFP and about 40-50% of infectivity in surface area is shown.

The human explant model is used to determine and optimize the efficiency of AAV-based delivery of broadly neutralizing antibodies ("bnAbs") to certain cellular components of the skin, the dose response and the temporal dynamics of bnAbs-secretion to the surrounding medium. The cellular tropism of a pool of AAV serotypes is tested. Exemplary candidates are selected with high degree of specificity to dermal fibroblasts, and efficacy of transcription and translation of two different anti-HIV bnAbs in human dermal fibroblasts is determined. A high-throughput approach is used to analyze a large pool of explants (maintained in multi-well organotypic chambers) using multiple infection doses and serotypes while accounting for donor-to-donor variability. According to one aspect, a pool of AAV serotypes in 5 different doses are tested for delivery of reporter genes to various cellular components of the skin in human skin explants derived from 5 different donors so as to establish cellular tropism independent of donor-to-donor variability. The AAVs encode a reporter gene of a suitable color. Immunostainings for specific markers are used to identify keratinocytes, epidermal stem cells, hair follicle stem cells, sebocytes, dermal fibroblasts, adipocytes precursors, mesenchymal stem cells and endothelial cells as preferential targets of the AAVs. Exemplary target cells are dermal fibroblasts due to their less differentiated state, uncommitted and potent transcriptional and translational machinery and fairly high abundance in the entire superficial dermis. See Krueger, G. G. Fibroblasts and dermal gene therapy: a minireview. *Hum Gene Ther* 11, 2289-96 (2000) and Birchall, J., Coulman, S., Pearton, M., Allender, C., Brain, K., Anstey, A., Gateley, C., Wilke, N. & Morrissey, A. Cutaneous DNA delivery and gene expression in ex vivo human skin explants via wet-etch micro-fabricated microneedles. *J Drug Target* 13, 415-21 (2005) each of which are hereby incorporated by reference in its entirety. Other cell types may also be used such as proliferating keratinocytes, particularly of those residing at the basal layer.

According to one aspect, different AAV serotypes encoding anti-HIV bnAbs are selected for dose escalating studies in a second subset of an array of skin explants from donors of varying gender, age, and race. Immunostaining experiments (for the respective anti-HIV bnAbs) are used to identify the optimal AAV infection dose for maximum expression of the bnAbs as well as for sustainability for the life of the explant culture (20 to 28 days).

According to one aspect, efficacy of secretion is evaluated by determining optimal regimen for bnAbs delivery in human skin explants and the ability of the infected cells inside the intact tissue to produce and secrete the respective anti-HIV broadly neutralizing antibodies. The explant culture system positions the dermal (bottom) surface of the tissue on a Biopore™ (PTFE) membrane cell strainer with the epidermis (the top) facing up. The dermis is kept in constant contact with the growth medium while the epidermis is exposed to air. This allows for a proper proliferation and differentiation of the keratinocytes (as in vivo) and mimics a contact of the dermis with the circulatory system.

The anti-HIV antibodies produced by the infected skin cells are analyzed by standard protocols such as ELISA of the conditioned medium.

Nucleic Acid Constructs

According to one aspect, nucleic acid constructs are provided for transmission into skin cells of a subject. The nucleic acid constructs may be included within a virus for introduction into a cell and for expression by the cell. The nucleic acid construct may be referred to as a payload construct. The payload constructs are expressed by the cell into which they are introduced by the plasmids, vector or viral vectors in which they are included. One of skill will be able to identify suitable plasmids, vectors and viral vectors and will also be able to design suitable nucleic acid constructs including one or more payload nucleic acids for expression by a cell. Various exemplary nucleic acid sequences and constructs are provided in Appendix A and Appendix B.

Regulatory elements are contemplated for use with the methods and constructs described herein. The term "regulatory element" is intended to include promoters, enhancers, internal ribosomal entry sites (IRES), and other expression control elements (e.g. transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif. (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g. liver, pancreas), or particular cell types (e.g. lymphocytes). Regulatory elements may also direct expression in a temporal-dependent manner, such as in a cell-cycle dependent or developmental stage-dependent manner, which may or may not also be tissue or cell-type specific. Regulatory elements may also direct expression in an inducible manner, such as in a small-molecule dependent or light-dependent manner. In some embodiments, a vector may comprise one or more pol III promoter (e.g. 1, 2, 3, 4, 5, or more pol III promoters), one or more pol II promoters (e.g. 1, 2, 3, 4, 5, or more pol II promoters), one or more pol I promoters (e.g. 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) (see, e.g., Boshart et al, Cell, 41:521-530 (1985)), the SV40 promoter, the dihydrofolate reductase promoter, the β-actin promoter, the phosphoglycerol kinase (PGK) promoter, and the EF1α promoter and Pol II promoters described herein. Also encompassed by the term "regulatory element" are enhancer elements, such as WPRE; CMV enhancers; the R-U5' segment in LTR of HTLV-I (Mol. Cell. Biol., Vol. 8(1), p. 466-472, 1988); SV40 enhancer; and the intron sequence between exons 2 and 3 of rabbit β-globin (Proc. Natl. Acad. Sci. USA., Vol. 78(3), p. 1527-31, 1981). It will be appreciated by those skilled in the art that the design of the expression vector can depend on such factors as the choice of the host cell to be transformed, the level of expression desired, etc. A vector can be introduced into host cells to thereby produce transcripts, proteins, antibodies, nanobodies, or peptides, including fusion proteins or peptides, encoded by nucleic acids as described herein.

Aspects of the methods described herein may make use of terminator sequences. A terminator sequence, includes a section of nucleic acid sequence that marks the end of a gene or operon in genomic DNA during transcription. This sequence mediates transcriptional termination by providing signals in the newly synthesized mRNA that trigger processes which release the mRNA from the transcriptional complex. These processes include the direct interaction of the mRNA secondary structure with the complex and/or the indirect activities of recruited termination factors. Release of the transcriptional complex frees RNA polymerase and related transcriptional machinery to begin transcription of new mRNAs. Terminator sequences include those known in the art and identified and described herein.

Aspects of the methods described herein may make use of epitope tags and reporter gene sequences. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-S-transferase (GST), horseradish peroxidase (HRP), chloramphenicol acetyltransferase (CAT) beta-galactosidase, betaglucuronidase, luciferase, green fluorescent protein (GFP), HcRed, DsRed, cyan fluorescent protein (CFP), yellow fluorescent protein (YFP), and autofluorescent proteins including blue fluorescent protein (BFP).

Exemplary nucleic acid constructs for the payload nucleic acid construct or the one or more foreign nucleic a sequences may include the regulatory elements within a backbone sequence as is known in the art for expressing the payload nucleic acid.

Skin Treatment and Cutaneous Foreign Nucleic Acid Transfer

According to one aspect, one or more foreign nucleic acids within a virus are transmitted to skin cells for a gene-based systemic protein delivery method as described herein. The skin is an exemplary organ or tissue for system delivery of a therapeutic or prophylactic agent because of its accessibility, rich vascularization and ability to release skin-produced polypeptides (such as engineered antibodies) to the blood stream. See Khavari, P. A., Rottman, O. & Vahlquist, A. Cutaneous gene transfer for skin and systemic diseases. *J Intern Med* 252, 1-10 (2002); Birchall, J., Coulman, S., Pearton, M., Allender, C., Brain, K., Anstey, A., Gateley, C., Wilke, N. & Morrissey, A. Cutaneous DNA delivery and gene expression in ex vivo human skin explants via wet-etch micro-fabricated micro-needles. *J Drug Target* 13, 415-21 (2005) and Coulman, S. A., Barrow, D., Anstey, A., Gateley, C., Morrissey, A., Wilke, N., Allender, C., Brain, K. & Birchall, J. C. Minimally invasive cutaneous delivery of macromolecules and plasmid DNA via microneedles. *Curr Drug Deliv* 3, 65-75 (2006) each of which is hereby incorporated by reference in its entirety. Skin based delivery methods also improves patient compliance together with precisely controlled and if desired pulsatile delivery of the polypeptide as a therapeutic or prophylactic agent agent.

As the skin provides a primary barrier to microbial invasion and desiccation, cutaneous tissue, however, possesses substantial obstacles to effective insertion of foreign DNA and/or viral particles. While various technologies are established for transdermal delivery of small and large molecules (see Guy, R. H., Hadgraft, & Bucks, D. A. Transdermal drug delivery and cutaneous metabolism. *Xenobiotica* 17, 325-43 (1987); Prausnitz, M. R. & Langer, R. Transdermal drug delivery. *Nat Biotechnol* 26, 1261-8 (2008); and Prausnitz, M. R., Mitragotri, S. & Langer, R. Current status and future potential of transdermal drug delivery. *Nat Rev Drug Discov* 3, 115-24 (2004)), methods described herein are directed to the skin cells being genetically modified by transduction with naked or viral vectors, such as rAAVs, as antibody DNA carriers so as to provide intradermal delivery. Methods described herein are well controlled and highly efficient in polypeptide production intradermally with minimal irritation, no wound healing and regenerative reaction to sustain prolonged expression of the IgGs.

According to one aspect, the skin is treated to facilitate or enable virus (AAV-vectored antibody) penetration through the stratum corneum and into the epidermal and dermal layers, and associated skin cells, below. According to one aspect, ultrasound is used to treat the skin prior to application of the virus to the skin. An exemplary method to treat the skin is cavitational, low-frequency ultrasound applied in a manner to reversibly disrupt the cutaneous stratum corneum and to enable rAAV transport into the epidermis, the papillary and reticulous dermis avoiding injury of the surrounding tissues. A person skilled in the art can choose the appropriate ultrasound device according to an application. To increase skin tissue permeation, ultrasound is applied to the skin tissue. A person skilled in the art can determine the frequency, intensity and duration of ultrasound application that is effective for a specific purpose. The ultrasonic pretreatment of skin tissue improves tissue diffusivity by increasing its effective diffusion coefficient. This process is enabled by the disruption of the skin's stratum corneum.

Cavitational ultrasound has been applied successfully in vivo in animals for the delivery of chemical compounds and RNA to the gastrointestinal tract. See Schoellhammer, C. M., Lauwers, G. Y., Goettel, J. A., Oberli, M. A., Cleveland, C., Park, J. Y., Minahan, D., Chen, Y., Anderson, D. G., Jaklenec, A., Snapper, S. B., Langer, R. & Traverso, G. Ultrasound-Mediated Delivery of RNA to Colonic Mucosa of Live Mice. *Gastroenterology* 152, 1151-1160 (2017) and Schoellhammer, C. M., Schroeder, A., Maa, R., Lauwers, G. Y., Swiston, A., Zervas, M., Barman, R., DiCiccio, A. M., Brugge, W. R., Anderson, D. G., Blankschtein, D., Langer, R. & Traverso, G. Ultrasound-mediated gastrointestinal drug delivery. *Sci Transl Med* 7, 310ra168 (2015) each of which are hereby incorporated by reference in its entirety. Notably, this technology has already been approved by the FDA for enhanced lidocaine delivery through the skin. See Becker, B. M., Helfrich, S., Baker, E., Lovgren, K., Minugh, P. A. & Machan, J. T. Ultrasound with topical anesthetic rapidly decreases pain of intravenous cannulation. *Acad Emerg Med* 12, 289-95 (2005) and Skarbek-Borowska, S., Becker, B. M., Lovgren, K. Bates, A. & Minugh, P. A. Brief focal ultrasound with topical anesthetic decreases the pain of intravenous placement in children. *Pediatr Emerg Care* 22, 339-45 (2006) each of which is hereby incorporated by reference in its entirety. Cavitational ultrasound uses low frequency (<100 kHz) to form, oscillate and collapse bubbles in an ultrasonic pressure field between the ultrasound probe and the skin surface. See Ogura, M., Paliwal, S. & Mitragotri, S. Low-frequency sonophoresis: current status and future prospects. *Adv Drug Deliv Rev* 60, 1218-23 (2008) and Paliwal, S., Menon, G. K. & Mitragotri, S. Low-frequency sonophoresis: ultrastructural basis for stratum corneum permeability assessed using quantum dots. *J Invest Dermatol* 126, 1095-101 (2006) each of which is hereby incorporated by reference in its entirety. According to one aspect, cavitational ultrasound is used to facilitate the transient permeabilization of the stratum corneum and to propel the viral particles inside the skin without damaging deeper tissues. Cavitational ultrasound is used without morphological signs of irritation, induced wound healing or compensatory regenerative response in the epidermis or underlying dermis both ex vivo and in vivo. According to one aspect, rAAV penetration into the skin is facilitated by treatment with cavitational ultrasound at 20 kHz, which is applied at an intensity of less than 8 $W/cm^2$ for up to one minute at a 50% duty cycle, for example, using a hand-held ultrasound device.

In some embodiments, ultrasound is applied at a frequency between about 20 kHz and about 100 kHz. In other embodiments, the ultrasound is applied at a frequency of about 10 kHz, 20 kHz, 30 kHz, 40 kHz, 50 kHz, 60 kHz, 70 kHz, 80 kHz, 90 kHz and 100 kHz. In some embodiments, the ultrasound is applied at an intensity of about 1, 2, 3, 4, 5, 6, 7, 8, 9 and 10 $W/cm^2$. In other embodiments, the ultrasound is applied at an intensity between about 1 $W/cm^2$ and about 10 $W/cm^2$. In some embodiments, the ultrasound is applied for a duration between about one minute to about 10 minutes. In other embodiments, the ultrasound is applied for a duration of about 1, 2, 3, 4, 5, 6, 7, 8, 9 and 10 minutes. In some embodiments, the ultrasound is applied at duty cycles in the range between about 10% and 100%. In some embodiments, the ultrasound is applied at duty cycles in the range between about 10%, 25%, 50%, 75% and 100%. In certain embodiments, the ultrasound is applied topically or intra-dermally.

According to one aspect, microdermabrasion is used to treat the skin prior to application of the virus to the skin. Microdermabrasion is an FDA approved process first introduced in the early nineties but quickly gained popularity for the treatment of scars, acne and other skin conditions due to high efficacy and simplicity of application. See Andrews, S., Lee, J. W. & Prausnitz, M. Recovery of skin beer after stratum corneum removal by microdermabrasion. *AAPS PharmSciTech* 12, 1393-400 (2011); Andrews, S. N., Zarnitsyn, V., Bondy, B. & Prausnitz, M. R. Optimization of microdermabrasion for controlled removal of stratum corneum. *Int J Pharm* 407, 95-104 (2011) and Gill, H. S., Andrews, S. N., Sakthivel, S. K., Fedanov, A., Williams, I. R., Garber, D. A., Priddy, F. H., Yellin, S., Feinberg, M. B., Staprans, S. I. & Prausnitz, M. R. Selective removal of stratum corneum by microdermabrasion to increase skin permeability. *Eur J Pharm Sci* 38, 95-103 (2009) each of which is hereby incorporated by reference in its entirety. Mechanistically, microdermabrasion involves impingement of micro-particles on the skin, which are then removed under vacuum along with the abraded dead superficial skin layer. In this manner, the stratum corneum is removed in a controlled fashion, without any collateral damage to the underlying viable cells of the skin.

Vector Design and Broadly Neutralizing HIV Antibodies/Nanobodies

According to one aspect, enhanced versions of viral cis vectors are designed or engineered to provide high transcription efficiency and capacity to translate encoding sequences of interest. One of skill may identify suitable vector designs through sequence optimizing practices used for the expression of single and double cistronic vectors and then testing in a highly homogenous reproducible in vitro system utilizing primary human cell cultures.

According to one aspect, methods are provided for the sustained production and cell-specific transfer of antibody-encoding transgenes to skin cells. Methods described herein are designed to limit off-target cellular tropism to fast proliferating epidermal cells which can lead to rapid clearance of transgenes. According to one aspect, fibroblasts or keratinocytes are genetically engineered for antibody production. Such cells have been shown to produce monoclonal antibody production, though using cell expansion from skin biopsies, ex vivo genetic modification with retroviral vectors, and intraperitoneal implantation of genetically modified cells embedded in artificial collagen matrix in mice. See Noel, D., Pelegrin, M., Brockly, F., Lund, A. H. & Piechaczyk, M. Sustained systemic delivery of monoclonal antibodies by genetically modified skin fibroblasts. *J Invest Dermatol* 115, 740-5 (2000) and Noel, D., Dazard, J. E., Pelegrin, M., Jacquet, C. & Piechaczyk, M. Skin as a potential organ for ectopic monoclonal antibody production. *J Invest Dermatol* 118, 288-94 (2002) hereby incorporated by reference in its entirety.

Exemplary methods described herein utilize adeno-associated virus vectors (AAVs) which induce minimal anti-vector immunity and effectively transduce long-lived and non-replicating cells in vivo thereby providing a single-step AAV-based antibody gene transfer system to skin which doesn't require genetic engineering ex vivo and enables high Ab secretion concentration to the blood stream.

The present disclosure provides an AAV-platform for skin gene transfer based on improved viral vector sequence for superior expression of transgenes encoding proteins in vivo. To simultaneously achieve high cell-transfer specificity and expression efficiency, a cis AAV2 vector was designed driven by human elongation factor-1 alpha (EF-1a) promoter allowing for universally strong expression (irrespective of cell type) and woodchuck hepatitis virus posttranscriptional regulatory element (WPRE)—transcription enhancement, length-optimized to ensure efficient plasmid packaging capacity in AAV. Triple transfection of HEK293 cells and iodixanol gradient purification is used for high-yield production of rAAV. For triple transfection, methods combine cis AAV vector (encoding for an exogenous AAV transgene), trans AAV rep/cap gene vector (encoding for the AAV replication-enabling gene of AAV2 and capsid of choice enabling rapid production of hybrid AAV virus), and adenovirus helper plasmid, pAdDF6.

One of skill can identify able vectors by testing vector constructs and determining specificity to dermal fibroblasts using an immunocompetent hairless mouse model to validated temporal expression. According to one aspect, an ultrasound-mediated gene delivery method is provided including 1) pretreating skin with ultrasound 2) topically administering the virus to the skin followed by passive-diffusion delivery to skin cells, 3) incubation, and 4) protein quantification after tissue harvesting (see FIG. 4A). Such a method was used to observe stable protein modulation of a single precursor gene of human collagen III (alpha domain), packaged in rAAV2/2 (wild type AAV2-AAV2 rep and AAV2 cap) (see FIG. 4B). Type III collagen is a human gene encoding collagen III fibrils, which serve as a major component of the skin extracellular matrix and is primarily produced by dermal fibroblast cells. Although it is not an immunomodulatory component, collagen III is lacking in hairless mice which allows for zero-background detection of overexpression that is well-detectable by a human-specific antibody assay. The amounts of protein production continued to increase over a period of 28 days, with expression levels reaching about 10-fold enhancement of protein expression over the internal negative control tissue both normalized by the amount present in normal human skin, demonstrating sustained transgene expression and protein production from rAAV vectors.

According to one aspect, wild type and hybrid AAV vectors are engineered to encode the full-length of broadly neutralizing antibodies (bnAbs) such as b12 and VRC01, which are validated bnAbs found to have satisfactory potency against the HIV transmitted founder strain REJO.c. These broadly neutralizing antibodies are exemplary only, as one of skill will readily be able to identify other polypeptides for certain therapeutic or prophylactic purpose. To enable constitutive expression of both the light and heavy chains in single mRNA transcript and thus an optimal stoichiometry, 2A-type elements (combinations of Furin site, GSG linker sequence, and 2A cleavage site) are screened for which generally have length advantage over other elements such as internal ribosomal entry site (IRES). The use of F2A element previously used in an AAV-delivery system is compared against other 2A-candidates, and cell immune response is monitored as a function of newly produced antibody titers. Immune response is measured by sequencing of the whole transcriptome identify off-target effects. In vitro validation of cleavage efficiency and processing quality of LC and HC of these vectors in 3D organotypic skin tissues is carried out. According to one aspect, methods are provided to identify and engineer EF-1a viral vectors whose cellular tropism is guided towards dermal skin fibroblasts. Activity of exemplary vectors may be confirmed in a mouse model and two human skin-mouse chimera models described herein.

According to certain aspects, camelid nanobodies may be delivered to skin cells in a subject by the engineered viruses described herein and the skin cells may then produce the camelid nanobodies which are then systemically delivered to the subject, such as by introduction into the circulatory system. Camelid nanobodies have a diverse target range (within an order of magnitude of mammalian antibodies) and high average specificity making them generally strong drug candidates, with their stability and pH tolerance making them resilient payloads for mucosal applications, and with their small size and relatively simple structure (90% of nanobodies feature no posttranslational modification) predisposing them for production by recombinant bacteria. See Muyldermans, S. Nanobodies: natural single-domain antibodies. *Annu Rev Biochem* 82, 775-97 (2013) hereby incorporated by reference in its entirety. *L. rhamnosus* GG (LGG) has been engineered to express an anti-gp120 nanobody that has been shown to hind 96 HIV-1 serotypes at levels comparable to high affinity, human IgG antibodies such as VRC01. See McCoy, L. E., Quigley, A. F., Strokappe, N. M., Bulmer-Thomas, B., Seaman, M. S., Mortier, D., Rutten, L., Chander, N., Edwards, C. J., Ketteler, R., Davis, D., Verrips, T. & Weiss, R. A. Potent and broad neutralization of HIV-1 by a llama antibody elicited by immunization. *J Exp Med* 209, 1091-103 (2012) hereby incorporated by reference in its entirety. Nanobodies are effective anti-HIV agents. Nanobodies purified from LGG demonstrate anti-HIV properties in a gold standard, gp120 ELISA binding assay as compared to 293F cell derived VRC01 IrG (see FIG. 5).

According to one aspect, camelid nanobodies are produced from recombinant virus as described herein and are used in an AAV-nanobody gene transfer method similar to the AAV-antibody gene transfer method described herein. The AAV is engineered for mammalian nucleus-specific effects of transcriptional processes and nuclear protein interactions, as well as codon optimization for mammalian expression. The short (about 300 bps) sequence and single chain of a nanobody require only standard cloning practices into the backbone of the optimized cis AAV vector sequence described herein. To determine efficacy, the mammalian nanobody AAV system is tested in human organotypic tissue screens. To determine efficacy, the mammalian nanobody AAV system is deliver in animal models to further validate efficiency of nanobody production and secretion amounts to the blood stream.

Potency of Antibody Gene Transfer

According to one aspect, the viral vectors described herein transfer one or more nucleic acid sequences encoding an antibody or nanobody to skin cells of a subject. The viral vectors replicate to other skin cells producing a plurality of skin cells that produce the antibody or nanobody which is secreted from the skin cells and is systemically delivered to the subject. Suitable viral vectors may be identified an engineered with the assistance of an in vitro system which has low sample-to-sample variability. Three-dimensional models of human skin, also called organotypic cultures, present such a system of constant parameters related to tissue thickness, homogeneity of cell type and spatial distribution, and cell surface density.

Established models for studying penetration through stratified human skin fall into two main categories: ex vivo skin explant cultures and regenerated three-dimensional organotypic models derived from freshly isolated primary human cells. According to the present disclosure, human skin explant systems are used in a high throughput fashion to assess viral tropism, dose response and efficacy of rAAV-assisted delivery of one or more target polypeptides, such as antibodies or nanobodies to skin cells. Skin explants provide preserved tissue morphology and presence of all resident cell types of the epidermis and dermis as well as skin appendages making them a useful system to assess potency of rAAV mediated recombinant antibody delivery to fibroblasts (primary target) and keratinocytes (secondary target). An additional exemplary system is 3D cultures of in vitro reconstituted human skin equivalents. These cultures include oprimary human dermal fibroblasts and epidermal keratinocytes pooled from various adult donors. See Duperret, E. K., Oh, S. J., McNeal, A., Prouty, S. M. & Ridky, T. W. Activating FGFR3 imitations cause mild hyperplasia in human skin, but are insufficient to drive benign or malignant skin tumors. *Cell Cycle* 13, 1551-9 (2014); Ratushny, V., Gober, M. D., Hick, R., Ridky, T. W. & Seykora, J. T. From keratinocyte to cancer: the pathogenesis and modeling of cutaneous squamous cell carcinoma. *J Clin Invest* 122, 464-72 (2012); Ridky, T. W., Chow, J. M., Wong, D. J. & Khavari, P. A. Invasive three-dimensional organotypic neoplasia from multiple normal human epithelia. *Nat Med* 16, 1450-5 (2010); and Truong, A. B., Kretz, M., Ridky, T. W., Kimmel, R. & Khavari, P. A. p63 regulates proliferation and differentiation of developmentally mature keratinocytes. *Genes Dev* 20, 3185-97 (2006) each of which is hereby incorporated by reference in its entirety. Upon contact with the air, the cultures are prompted to form a full thickness multilayer model of intact human skin. The dermis and the epidermis are separated by an intact basement membrane, remain metabolically and mitotically active and thus perfectly mimic in vivo characteristics (see FIG. 6A).

Gene and protein modulation of collagen III was carried out in vitro in human3D skin equivalents. Viral vectors of rAAV2/2: COL3A1 were delivered, and a 2.8-fold increase in the gene expression of COL3A1 at day 3 was measured. Measured by Western blotting, collagen levels show about a 2-fold enhancement relative to reference control of human skin, both normalized to the negative control (untreated) (see FIG. 6B).

According to one aspect, efficacy of an AAV:anti-HIV bnAb delivery system is characterized using 3D skin equivalents in terms of (i) dose response; (ii) antibody secretion; and (iii) donor-to-donor variability. Dose-escalating studies with rAAV-Ab chimeras estimate the potency of ultrasound-assisted infection of dermal fibroblasts and epidermal cells in arrays of organotypic cultures. A time-course ELISA of the conditioned medium through the life of the cultures (20 days) estimate levels of secreted antibodies. Immunostaining experiments at the end of the studies assess the efficacy of infection fibroblasts versus keratinocytes. The pooled nature of the primary cell cultures (at least 6 different donors per plate of equivalents) equalize donor-to donor variability for robustness of the analysis. Major differences in skin morphology among individuals of different ages and skin types is accounted for by utilizing an established repository of a variety of primary cultures of keratinocytes and fibroblasts which currently contains cells derived from Caucasian as well as African American donors varying from 18 to 72 years of age.

Delivery to Skin Tissues

According to one aspect, the engineered viral vectors described herein are transferred into dermal and/or epidermal cells to generate durable expression and secretion of biologically active polypeptides, such as HIV bnAbs in vivo. Exemplary delivery methods include topically applying the viruses described herein to the skin surface. The virus may be included in a topical formulation known to those of skill in the art for application to skin. Other delivery methods known to those of skill in the art can be used to deliver the recombinant viruses to the skin. These delivery methods comprise (1) electroporation such as by applying short high voltage pulses to the skin, (2) heating the formulation as it is applied to the skin (37° C.), (3) needleless injections such as by firing liquid at supersonic speed through the stratum corneum, (4) pressure waves generated by laser radiation, fraction laser, or radiofrequency (100 kHz), (5) magnetophoresis by external magnetic field, (6) iontophoresis, (7) applying a chemical peel to the skin followed by application of the virus to the treated skin surface, (7) abrasion techniques such as diamond or sand paper abrasion, tape stripping, and the like followed by application of the virus to the treated skin surface. A skilled in the art can choose the appropriate delivery method according to an application. These methods can be used in combination with the method of ultrasound pre-treatment of skin and administering of the recombinant viruses as disclosed herein.

Delivery of either autologous fibroblasts (or keratinocytes) genetically modified to express therapeutic antibodies into the skin of immune-competent mice are able to achieve serum concentrations of secreted therapeutic antibodies between 1 and 3 μg/ml. According to the present disclosure, methods are provided to infect large numbers of fibroblasts and/or keratinocytes with the viral vectors vector described herein to achieve concentrations of a therapeutic or prophylactic polypeptide suitable for treatment of a disease or condition or prevention of a disease or condition. Contrary to other delivery approaches such as intramuscular injections, the non-invasive ultrasound assisted method described herein utilizes large skin areas to target cell numbers that are orders of magnitudes higher than cell numbers achievable through intramuscular injections. In addition, idiotypic anti-antibody response of the host is minimal in animals receiving dermal fibroblasts engineered to express therapeutic antibodies.

Figure 7:
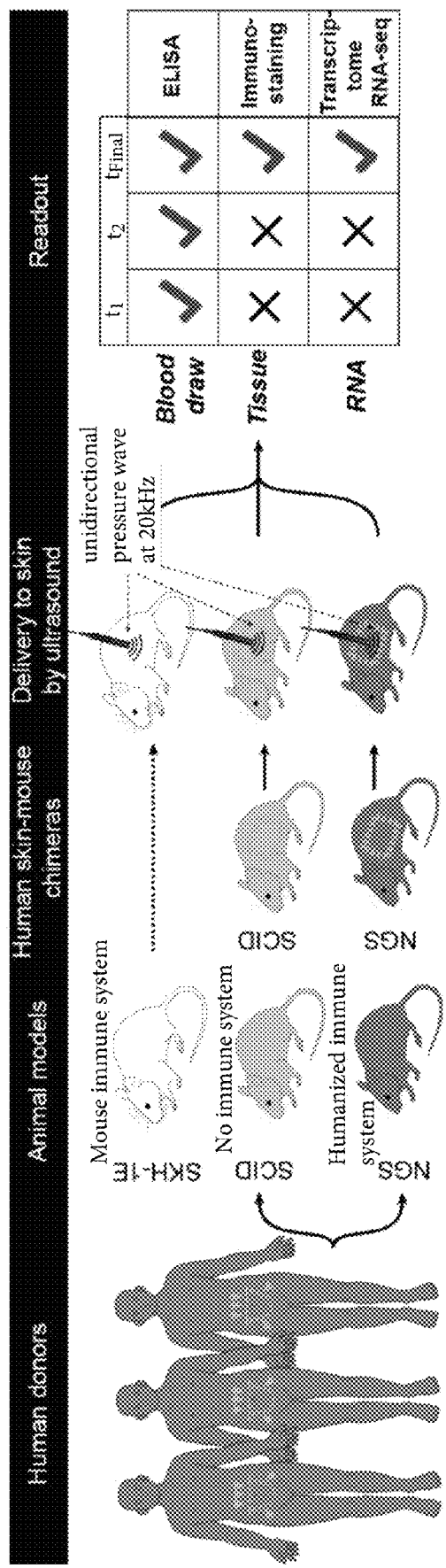
FIG. 7 depicts a platform for akin gene therapy in vivo. Critical workflow steps include animal models, creation of human-mouse chimeras, skin-delivery method and basic readout metrics.

According to one aspect, the rAAV viral vectors described, herein provide cellular tropism and selective targeting of the one or more target polypeptides, such as HIV bnAbs, to dermal fibroblasts. According to one aspect, off-target delivery provides a level of rAAV infection of epidermal progenitors and differentiating keratinocytes. Although transitory (due to the rapid keratinocyte turnover), the resulting expression of bnAbs, for example, in the epidermis may only increase the efficacy of the method because, proteins as big as 150 kDa, after release by engineered basal keratinocytes into skin intercellular spaces, can migrate to the general circulation. Feasibility of rAAV-vectored gene transfer into dermal (and off-target epidermal) cells, and effective durable expression and secretion of biologically active HIV bnAbs in vivo can be determined by three models of SKH-1E mouse, SCID (severe combined immunodeficiency) mouse, and NSG (NOD SCID Gamma) mouse. An experimental platform is shown in FIG. 7 for skin gene therapy using animal models, creation of human-mouse chimeras, skin-delivery method and basic readout metrics necessary to determine successful workflow.

According to one aspect, a method is provided for rAAV-vectored gene transfer of biologically active HIV bnAbs into the skin of a mammal such as a human or mouse. Immune-competent hairless mice (SKH-1E mouse model) are suitable models for efficacy in human skin. The skin of hairless mice is widely utilized as a substitute for human skin to measure percutaneous drug penetration in vivo. In general, hairless mouse skin is slightly more permeable than human skin but it is by far less permeable than the skin of haired mice, rats and dogs. Ultrasound or dermal micro-abrasion is used to treat the skin of the mammal. Selected rAAV serotypes carrying the active HIV bnAbs are administered to the treated skin and the rAAV infects skin cells and delivers the nucleic acid sequence encoding the active HIV bnAbs. The infected skin cells produce the active HIV bnAbs which are secreted from the cells and travel into the circulatory system. Suitable dose regimens may be determined using different dose regimens applied to animals. Immunostaining for the respective anti-HIV bnAbs to identify the optimal rAAV infection dose may be used. Co-staining studies may be carried out to determine cellular tropism or preferential targeting of the rAAV vectors to dermal fibroblasts (and keratinocytes). Dynamic changes of HIV bnAbs levels in the plasma of the animals up to 3 months, post infection may be determined. Anti-transgene immunological response may be determined.

According to one aspect, a method is provided for rAAV-vectored gene transfer of biologically active HIV bnAbs into the skin of a mammal, such as a human or mouse. Immune-deficient SCID (severe combined immunodeficiency) mice having human skin grafted thereto are suitable models for efficacy in human skin. SCID mice lack both humoral and cellular immunity. Transplantation of human skin by grafting on the SCID mice was established several years ago and is currently widely used as a xenograft model for the investigation of human skin under in vivo conditions. The SCID-human chimeras have fairly high rates of graft acceptance and although acanthosis and hyperkeratosis develop later (9 months after grafting), the human skin at earlier time points preserves normal physiology and morphology. See Kappes, U., Schliemann-Willers, S., Bankova, L., Heinemann, C., Fischer, T. W., Ziemer, M., Schubert, H., Norgauer, J., Fluhr, J. W. & Elsner, P. The quality of human skin xenografts on SCID mice: a noninvasive bioengineering approach. *Br J Dermatol* 151, 971-6 (2004) and Kaufmann, R., Mielke, V., Reimann, J., Klein, C. E. & Sterry, W. Cellular and molecular composition of human skin in long-term xenografts on SCID mice. *Exp Dermatol* 2, 209-16

(1993) each of which is hereby incorporated by reference in its entirety. A large cohort of SCID-human skin xenografts are created using donor human skin with the same parameters of the human explant studies described herein. Complete wound healing is achieved 7-8 weeks after procedure. The rAAV vectored delivery of the bnAbs is started 10 weeks after grafting and uses the same experimental set up as for the hairless mice (with 20 mice per group projecting successful grafts at about 50%). The area of grafted skin is usually 1.5-2 cm$^2$ and the ultrasound-assisted delivery of AAVs is applied to the entire graft. Methods described herein include the repeated delivery of rAAVs to the subject. The human skin in SCID mice is well vascularized, efficiently connected to the host circulation and it also preserves the existence of normal human immune cells. Therefore, the model allows one to measure the efficiency of antibody production over time and the sustainability of antibody levels in the host plasma. Skin grafts may be harvested and stained for immune cell specific markers to detect the status of the dormant T- and dendritic cells, while cytokine expression levels may be measured by quantitative RT-PCR.

According to one aspect, a method is provided for rAAV-vectored gene transfer of biologically active HIV bnAbs into the skin of a mammal, such as a human or mouse. Humanized NSG mice having human skin grafted thereto are suitable models for efficacy in human skin. Skin grafts in NSG mice have significantly higher degree of preservation of dormant human immune cells in the grafts and therefore present a suitable model to study local immune reactions. See Soria, A., Boccara, D., Chonco, L., Yahia, N., Dufossee, M., Cardinaud, S., Moris, A., Liard, C., Joulin-Giet, A., Julithe, M., Mimoun, M., Combadiere, B. & Perrin, H. Long-term maintenance of skin immune system in a NOD-Scid IL2rgamma(null) mouse model transplanted with human skin. *Exp Dermatol* 23, 850-2 (2014) hereby incorporated by reference in its entirety. Human skin transplanted onto NSG mice develops an inflammatory infiltrate, consisting predominately of host Gr1+ cells, that is detrimental to the survival of human endothelium in the graft. See Racki, W. J., Covassin, L., Brehm, M., Pino, S., Ignotz, R., Dunn, R., Laning, J., Graves, S. K., Rossini, A. A., Shultz, L. D. & Greiner, D. L. NOD-scid IL2rgamma(null) mouse model of human skin transplantation and allograft rejection. *Transplantation* 89, 527-36 (2010) hereby incorporated by reference in its entirety. Therefore, graft recipients are treated with anti-Gr1 antibody, shown to reduce this cellular infiltrate, preserve the graft endothelium, and promote wound healing, tissue development and graft remodeling. Graft integrity of the transplanted skin is achieved, which includes multilayered stratified human epidermis, well developed human vasculature, human fibroblasts and passenger leukocytes.

The practice of the disclosed methods employs, unless otherwise indicated, conventional techniques of immunology, biochemistry, chemistry, molecular biology, microbiology, cell biology, genomics and recombinant DNA, which are within the skill of the art. See Sambrook, Fritsch and Maniatis, MOLECULAR CLONING: A LABORATORY MANUAL, 2nd edition (1989); CURRENT PROTOCOLS IN MOLECULAR BIOLOGY (F. M. Ausubel, et al. eds., (1987)); the series METHODS IN ENZYMOLOGY (Academic Press, Inc.): PCR 2: A PRACTICAL APPROACH (M. J. MacPherson, B. D. Hames and G. R., Taylor eds. (1995)), Harlow and Lane, eds. (1988) ANTIBODIES, A LABORATORY MANUAL, and ANIMAL CELL CULTURE (R. I. Freshney, ed. (1987)).

Embodiment

The present disclosure describes a method of systemic delivery of a polypeptide to a subject including genetically modifying target skin cells within skin of a subject by administering to the subject an engineered virus or plasmid vector or naked viral vector including one or more foreign nucleic acid sequences encoding one or more target polypeptides, wherein the one or more foreign nucleic acid sequences of the engineered virus are introduced into the target skin cells within the skin to produce genetically modified skin cells, and wherein the genetically modified skin cells produce the one or more target polypeptides by expression of the one or more foreign nucleic acid sequences, and wherein the one or more target polypeptides are excreted from the genetically modified skin cells and are introduced systemically within the subject. According to one aspect, the engineered virus is nonreplicative. According to one aspect, the engineered virus is replicative. According to one aspect, the engineered virus is transmitted in vivo between target skin cells to create additional genetically modified skin cells producing the one or more target polypeptides. According to one aspect, the engineered virus is replicative and is transmitted in vivo between target skin cells to create additional genetically modified skin cells producing the one or more target polypeptides. According to one aspect, administering the engineered virus comprises topically applying a formulation comprising the engineered virus to skin of the subject. According to one aspect, the genetically modified skin cells are long-lived and non-replicating. According to one aspect, the polypeptide is a therapeutic agent. According to one aspect, the engineered virus is a genetically modified virus. According to one aspect, the engineered virus is a non-integrative viral vector. According to one aspect, the engineered virus is an adeno-associated viral vector. According to one aspect, the one or more target polypeptides is an antibody or nanobody. According to one aspect, the genetically modified skin cells produce the one or more target polypeptides over a sustained period of time. According to one aspect, the genetically modified skin cells produce the one or more target polypeptides over a sustained period of time to provide immunity against a target disease. According to one aspect, the genetically modified skin cells produce the one or more target polypeptides over a sustained period of time to provide immunity against one or tore target antigens. According to one aspect, the one or more target polypeptides are introduced systemically within the subject by introduction into a circulatory system of the subject. According to one aspect, the subject is a mammal. According to one aspect, the subject is a human. According to one aspect, the skin cells are human skin cells. According to one aspect, the one or more target polypeptides include a neutralizing antibody against HIV-1. According to one aspect, the one or more target polypeptides include a broadly neutralizing antibody against HIV-1. According to one aspect, the one or more target polypeptides include a fibroblast-facilitated neutralizing antibody against HIV-1. According to one aspect, the one or more target polypeptides include a camelid nanobody. According to one aspect, the skin is treated to be permeabilized to the engineered virus. According to one aspect, stratum corneum of the skin is processed to be permeabilized to the engineered virus. According to one aspect, the skin is pretreated with cavitational ultrasound or microdermabrasion to disrupt the cutaneous stratum corneum, and wherein the engineered virus is transported to the epidermis, the papillary and reticulous dermis. According to one aspect, the skin cells are dermal fibroblast cells or epidermal progenitor cells. According to one aspect, the skin is treated with ultrasound prior to administering the recombinant virus. According to one aspect, the skin is treated with ultrasound prior to administering the recombinant virus and ultrasound is stopped prior to administering the recombinant virus. According to one aspect, the skin treated with ultrasound at a frequency between about 0 kHz and about 100 kHz. According to one aspect, the skin is treated with ultrasound applied at an intensity between about 1 W/cm$^2$ and about 10 W/cm$^2$. According to one aspect, the skin is treated with ultrasound applied for a duration between about one minute to about 10 minutes. According to one aspect, the skin is treated with ultrasound applied at duty cycles in the range of between 25% and 100%. According to one aspect, the skin is treated with ultrasound applied topically or intra-dermally. According to one aspect, the engineered virus is a retrovirus, adenovirus, adeno-associated virus (AAV), vaccinia virus or herpes simplex virus. According to one aspect, the engineered virus is a recombinant AAV of serotype 1, 2, 3, 4, 5, 6, 7, 8 or 9.

Example I

Optimization of Gene Transfer to Whole Skin

Figure 8A:
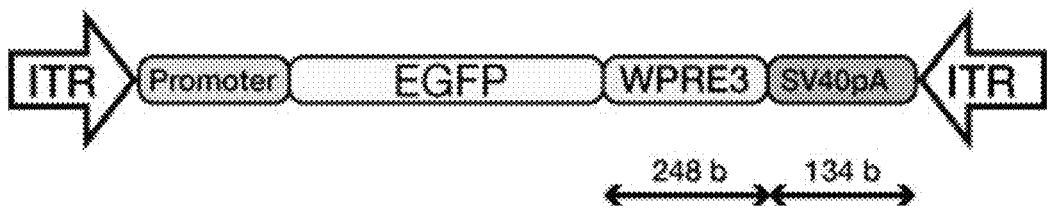
FIGS. 8A-8H show results of EGFP expression in whole skin cells.

To create an optimal framework for delivery of transgenes to skin cells, fluorescent enhanced GFP reporter transgene was cloned in an AAV vector containing AAV2-derived inverted terminal repeat 1 (ITR1) in the flip direction and an inverted terminal repeat 2 (ITR2) in the flop direction. The ITR1 element is annealed to human hEF1a elongation factor-1 alpha) promoter, while ITR2 element is annealed to 134b-long SV40 late polyadenylation (truncated SV40 late poly(A)) element and 248b-long WPRE3 (truncated) element. FIG. 8A shows a schematic of a length-optimized modular vector with EGFP gene inserted. The gene is flanked by unique SpeI and NotI restriction sites. The gene is preceded by a Kozak sequence (GCCACC) and is terminated by a (TAA) stop codon, prior to the NotI restriction site.

To evaluate the efficacy of gene transfer to human skin cells, a variety of AAV capsids were used to make hybrid AAV viral serotypes. A typical workflow is shown on FIG. 8B. These vectors were delivered topically to human skin explants pre-treated with low frequency (20 kHz) ultrasound. Sonic wave with a period 30 sec and duration of 3 cycles was generated to permeabilize abdominal human skin by disrupting its cornified layer—the stratum corneum. Recombinant AAV viruses of serotypes 2/1, 2/2, 2/5, 2/6.2, 2/7, 2/8, 2/9, and 2/10 were administered at a dose of 2E+11 GC per 1.2 cm-dia full-thickness human skin. After AAV-treatment, human skin explants were cultured in 1 cm-transwells for 8 days after which tissues were analyzed for gene expression. As shown on FIG. 8C, the capsids of AAV2/5, AAV2/2, AAV2/6.2, and AAV2/8 gave the most robust gene expression characterized by gene expression of the transgene in whole skin lysate. Reported gene expression values were normalized to endogenous Active-beta (ACTB) levels relative to a control untreated tissue. Next, in FIG. 8D, the absolute gene expression copy number was evaluated based on a standard curve built upon known amounts of input transgene. Similarly, AAV2/5, AAV2/6.2, AAV2/2, and AAV2/8 presented with the highest expression values, FIGS. 8A-8C show mean and standard error to the mean of N=2 replicates.

Figure 8B:
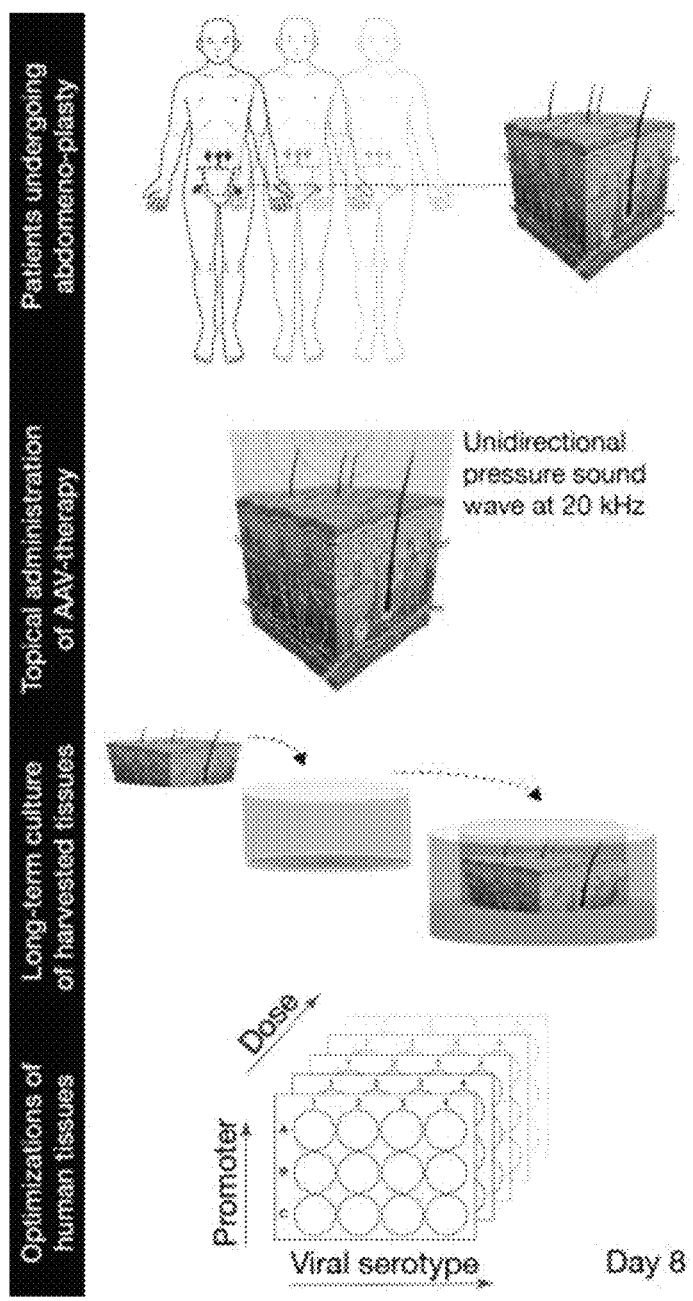
Figure 8C:
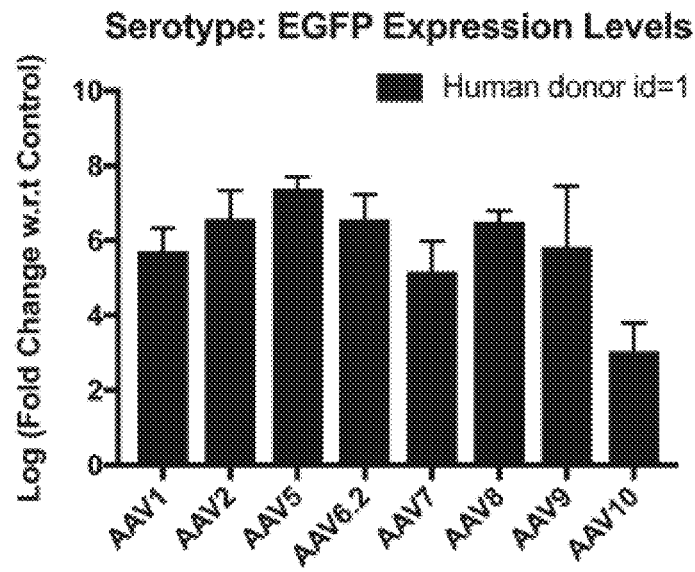
Figure 8D:
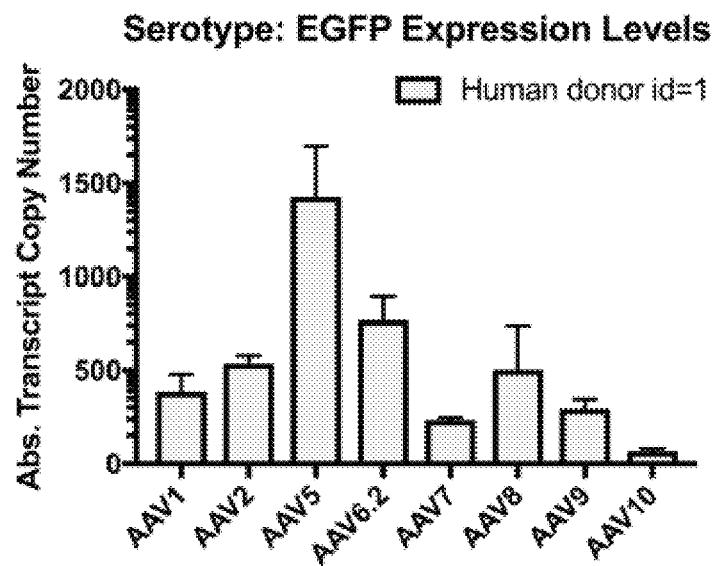
Figure 8E:
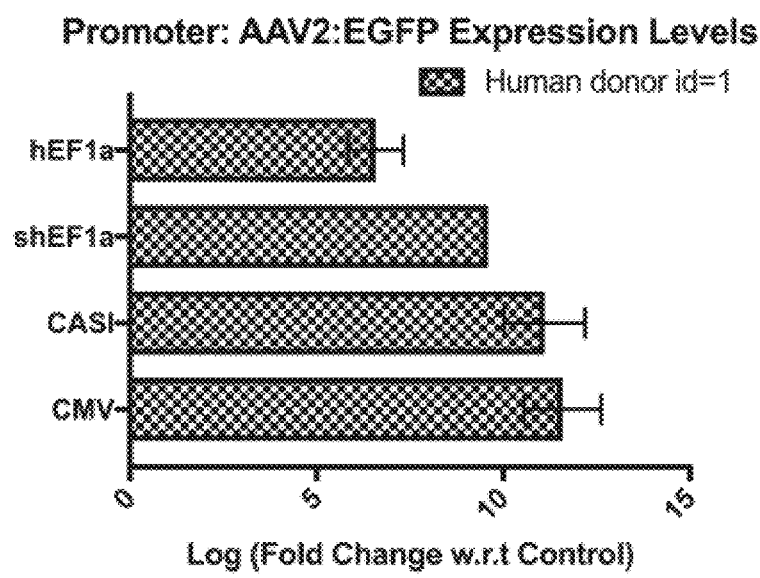
Figure 8F:
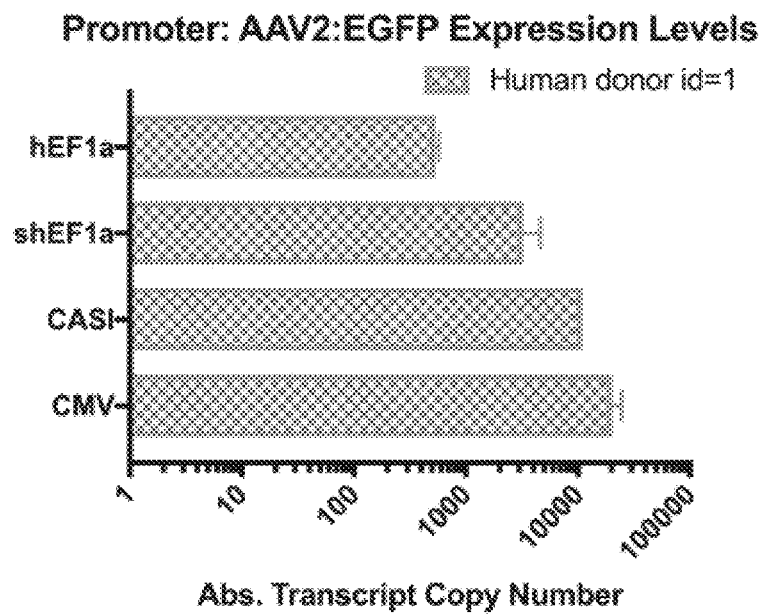

To determine the expression potential of a panel of viral promoters in human skin tissue, a group of ubiquitous and tissue-specific promoters was tested in human skin explants as represented in the workflow of FIG. 8B. The tested panel included cytomegalovirus immediate early promoter (CMV), CASI promoter (a fusion of cytomegalovirus immediate early promoter (CMV) followed by a fragment of chicken-f-actin (CAG) promoter), short human elongation factor-1 alpha (shEF1a), and human elongation factor-1 alpha (hEF1a). Recombinant AAV2 serotype at a dose of 2E+11 GC per 1.2 cm-dia full-thickness human skin was administered to all tissue explants. The strength of human skin cell expression of each promoter was evaluated by the gene expression of reporter gene, EGFP both in terms of relative (to negative control) expression (FIG. 8E) and absolute copy number expression (FIG. 8F). FIGS. 8E-8F show mean and standard error to the mean of N=2. replicates. Within the duration of the experiment at day 8, CMV and CASI presented with the highest expression potential while shEF1a presented with levels on the same order.

Figure 8G:
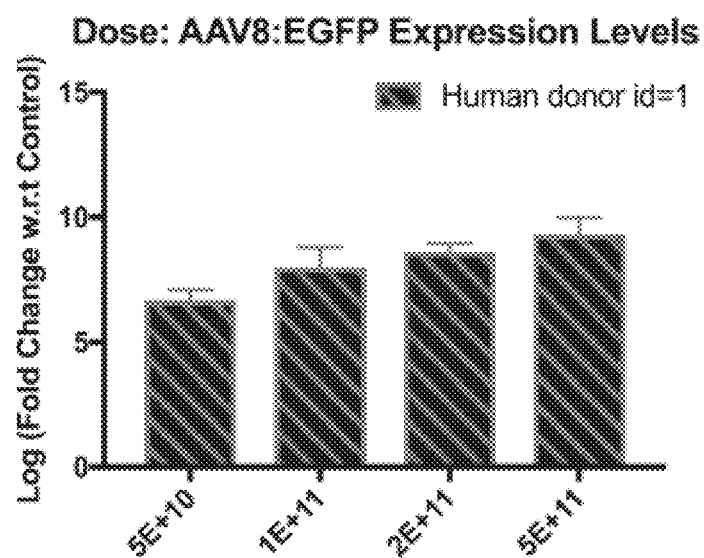
Figure 8H:
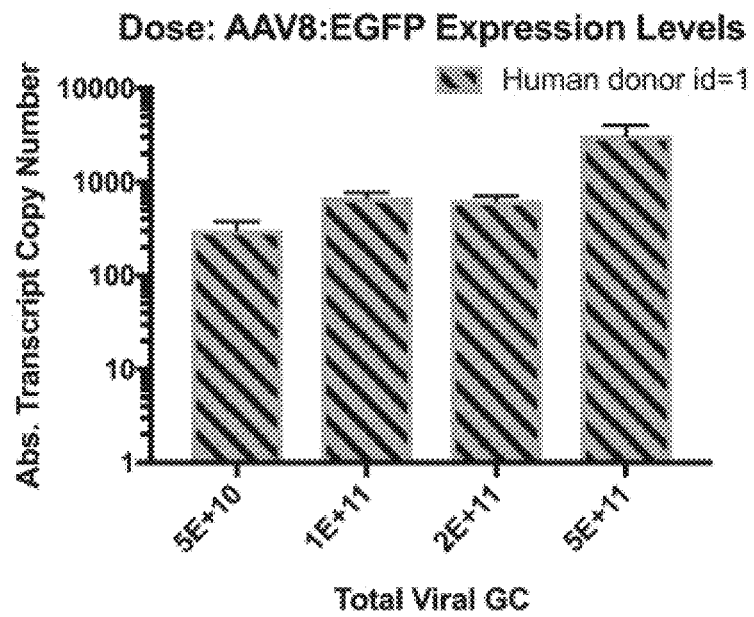

To confirm dose-dependency within the range of use, AAV2/8-hEF1a-EGFP was administered to human skin explants at the doses of 5E+10, 1E+11, 2E+11, and 5E+11 GC. The strength of cell expression was evaluated by the gene expression of reporter gene, EGFP both in terms of relative negative control) expression (FIG. 8G) and absolute copy number expression (FIG. 8H). A typical dose of 2E+11 yielded a total of 642 EGFP transcripts.

Example II

Optimization of Gene Transfer to Human Skin Dermis

Figure 9A:
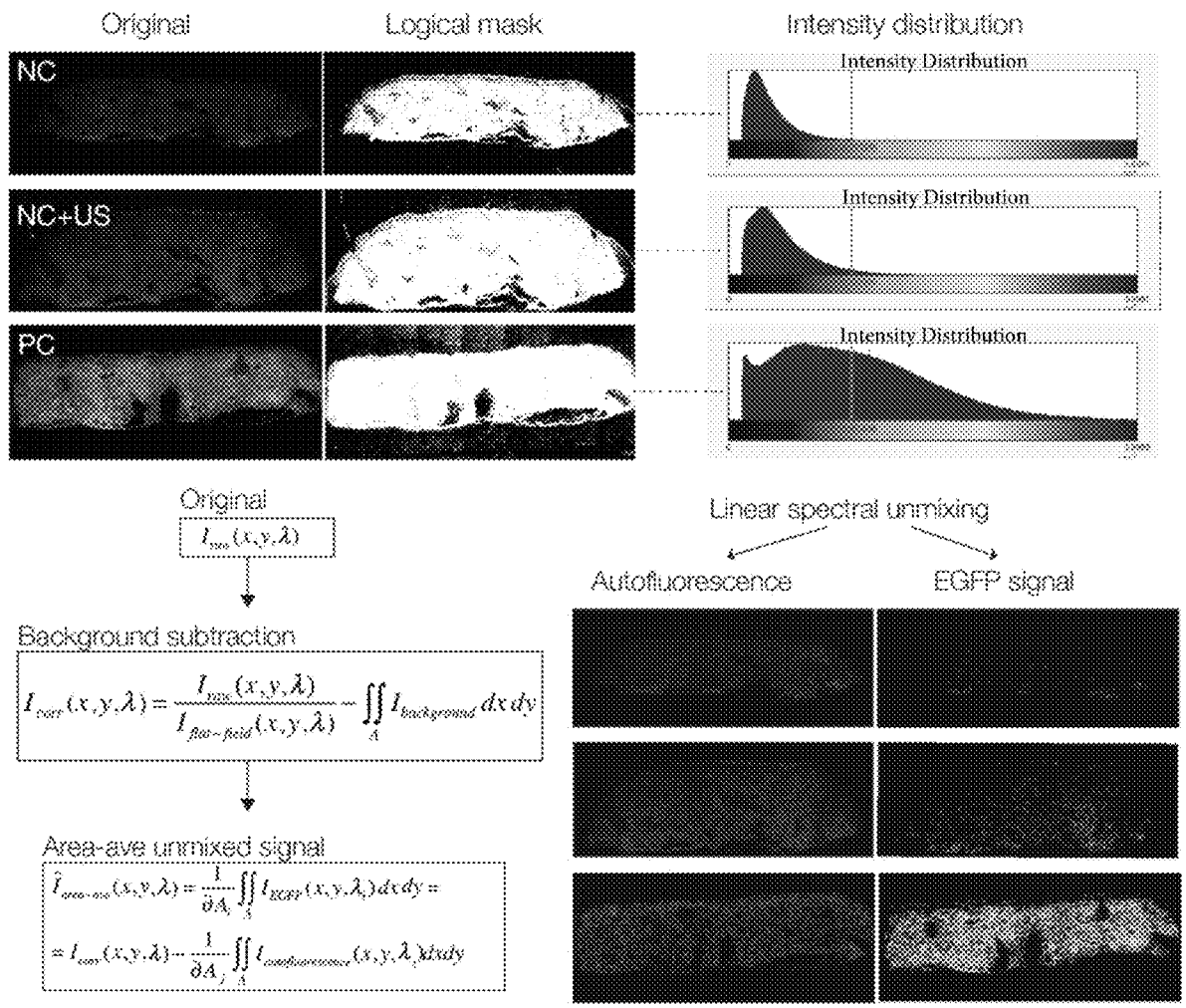
FIGS. 9A-9E show results of gene delivery efficiency to dermal skin cells according to certain embodiments of the disclosure.
Figure 9B:
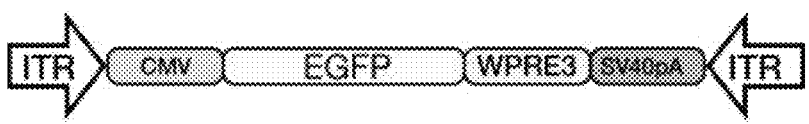

To establish delivery efficiency selectively to dermal skin cells, the native fluorescence of a reporter gene, EGFP was measured over a large surface area in full thickness human breast skin tissues (16 mm×2 mm in cross-sectional area) maintained in culture conditions post-treatment. Human skin explants were harvested 24 hours after the treatment, and embedded in OCT. To determine the total signal over the cross-sectional area of the dermis (16 mm×1 mm×20 μm), native GFP fluorescence was quantified using a custom image post-processing pipeline in MatLab. The algorithm executes flat-field and background corrections, creates a logical mask of the image, and performs linear un-mixing of the total fluorescence intensity based upon different emission spectra of tissue auto-fluorescence and signal due to the expression of EGFP. The process is shown in FIG. 9A for one untreated, one ultrasound-treated, and one AAV-treated tissue sample. A schematic illustration of AAV-CMV-EGFP vector is shown in FIG. 9B.

Figure 9C:
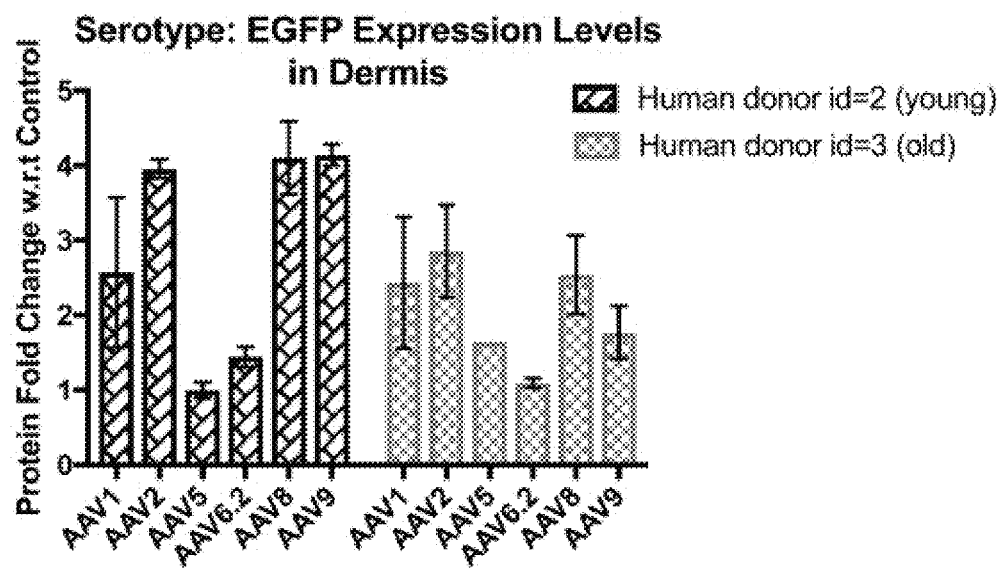
Figure 9D:
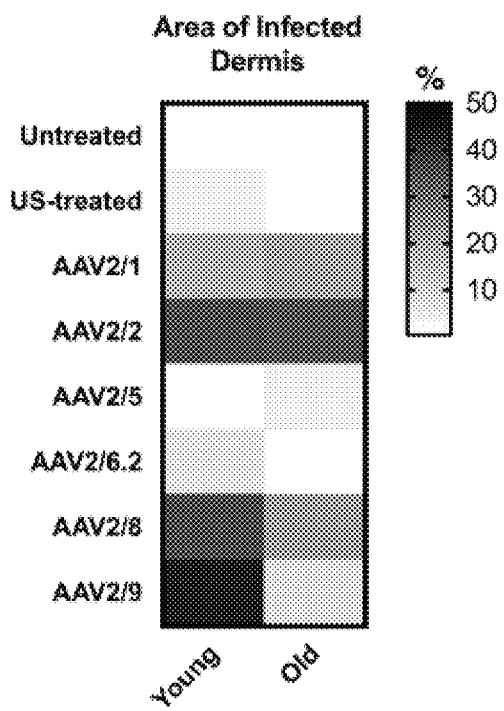

Recombinant AAV viruses of serotypes 2/1, 2/2, 2/5, 2/6.2, 2/8, 2/9 were administered at a dose of 2E+11 GC per tissue explant and the fluorescence signal is reported for two donors, one young (of ages 30) and one old (of age 52) in FIG. 9C. While expression levels differed between the two human donors, the optimal gene expression in dermal cells was consistent and the highest for AAV2/8, AAV2/2, AAV2/9, and AAV2/1. The highest amount of protein expression reached 4-fold over that of an untreated-tissue, and covered nearly 50% of the cross-sectional dermal area in the young donor, as shown on the heatmap of FIG. 9D. Large variation was observed between the two donors.

Figure 9E:
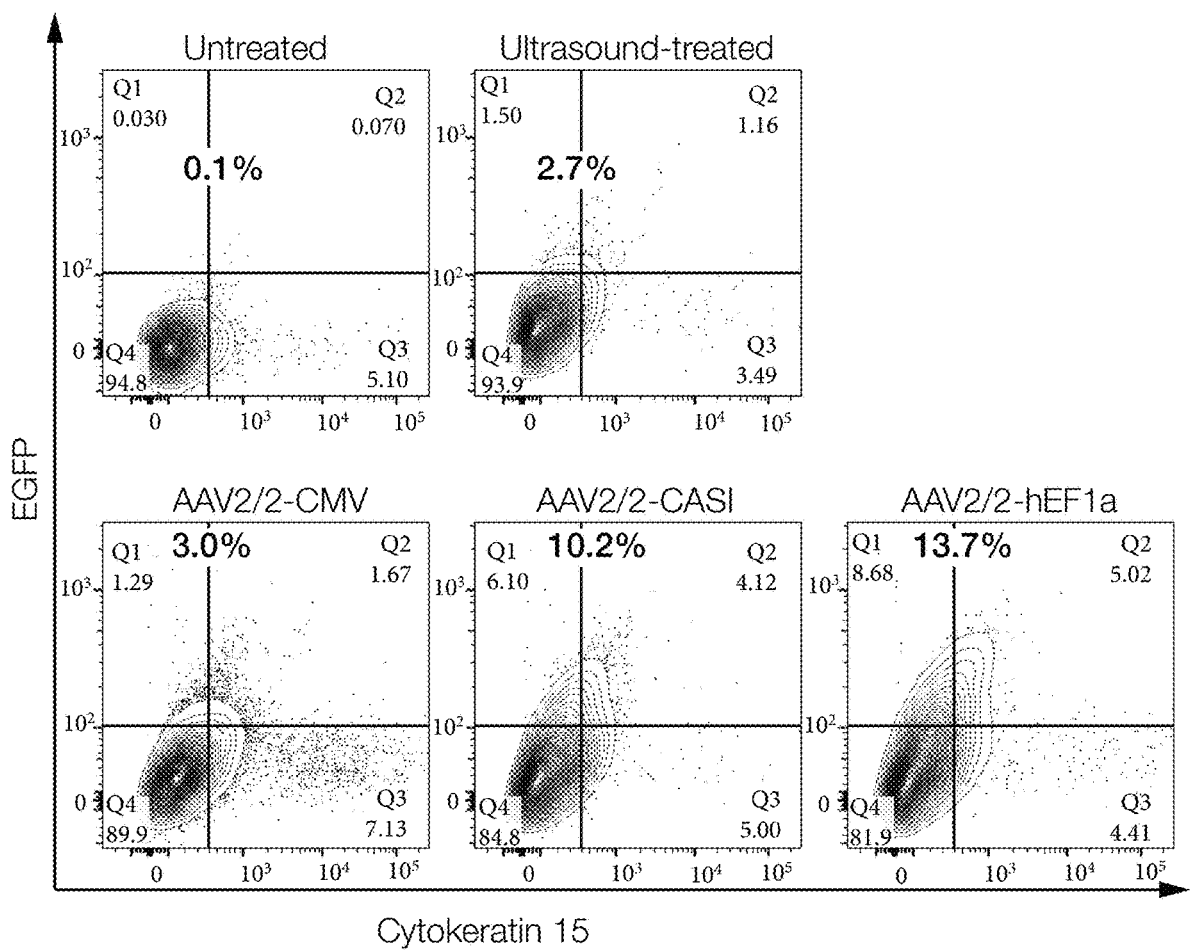

The infectivity of the CMV promoter in human dermal cells shows a transient response over time and is the highest during the first week of infection. To quantify longer term expression response in the human dermis, skin explants (from human donor id=4 of medium age) were AAV2- infected with CMV, CASI, and hEF1a promoters and harvested at Day 12. To separate epidermis from dermis, explants were treated with a protease (dispase II at 5 U/ml, overnight) to facilitate peeling off the epidermis. A population of dermal cells (predominantly skin fibroblasts) was then dissociated using Collagenase I at 1 mg/ml in DMEM/ Serum (20%) solution at 37 C. The isolated cells were stained with anti-EGFP and anti-Cytokeratin 15 antibodies for processing with FACS. A population of ~30,000 cells was analyzed. As shown on FIG. 9E, the populations of single EGFP-positive cells and double EGFP/K15-positive cells were summed and the highest infectivity capacity yielded a total of 13.7% for the hEF1a-driven AAV vector.

Example III

Optimization of Gene Transfer to Human Skin Epidermis

Figure 10B:
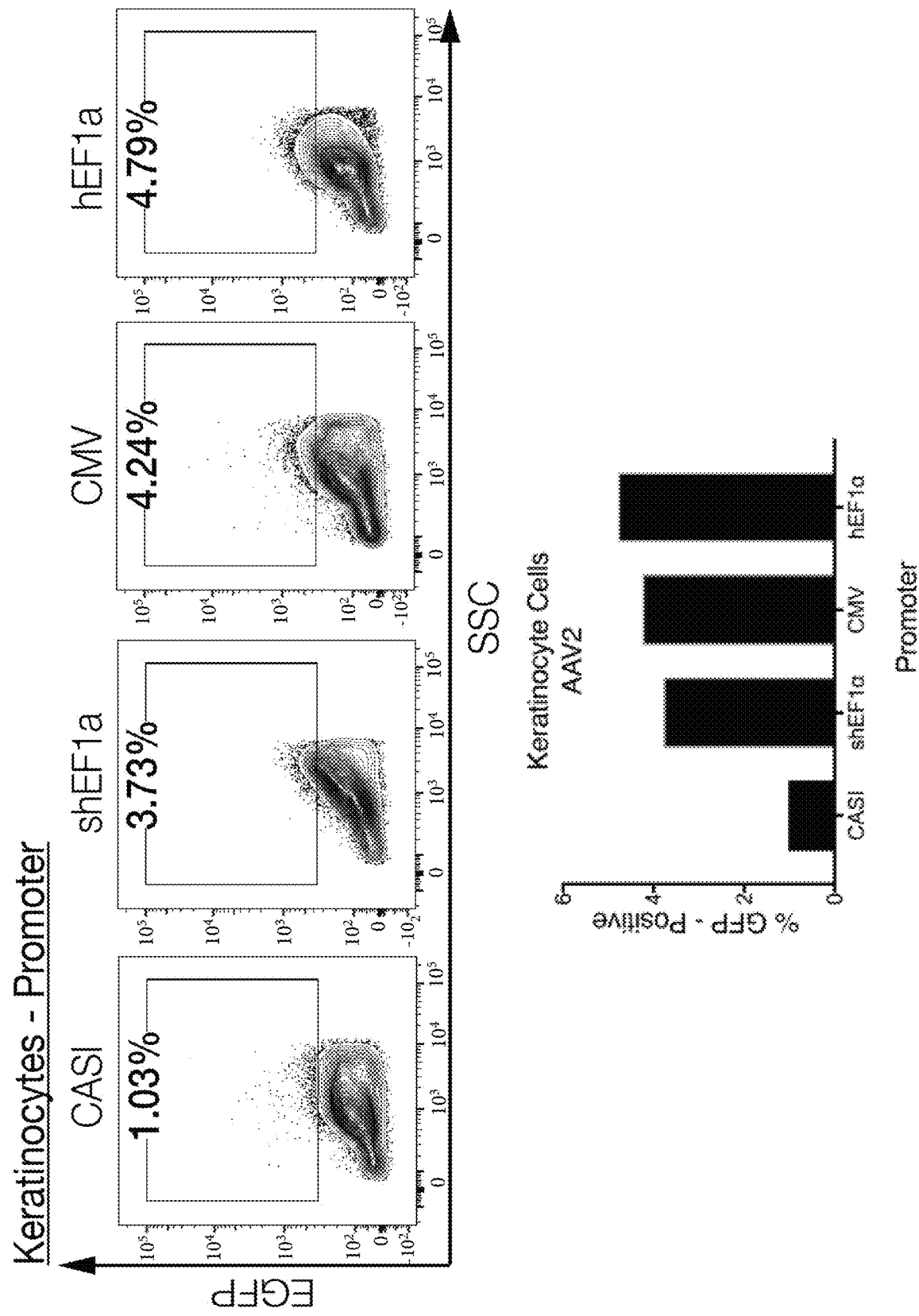
Figure 10C:
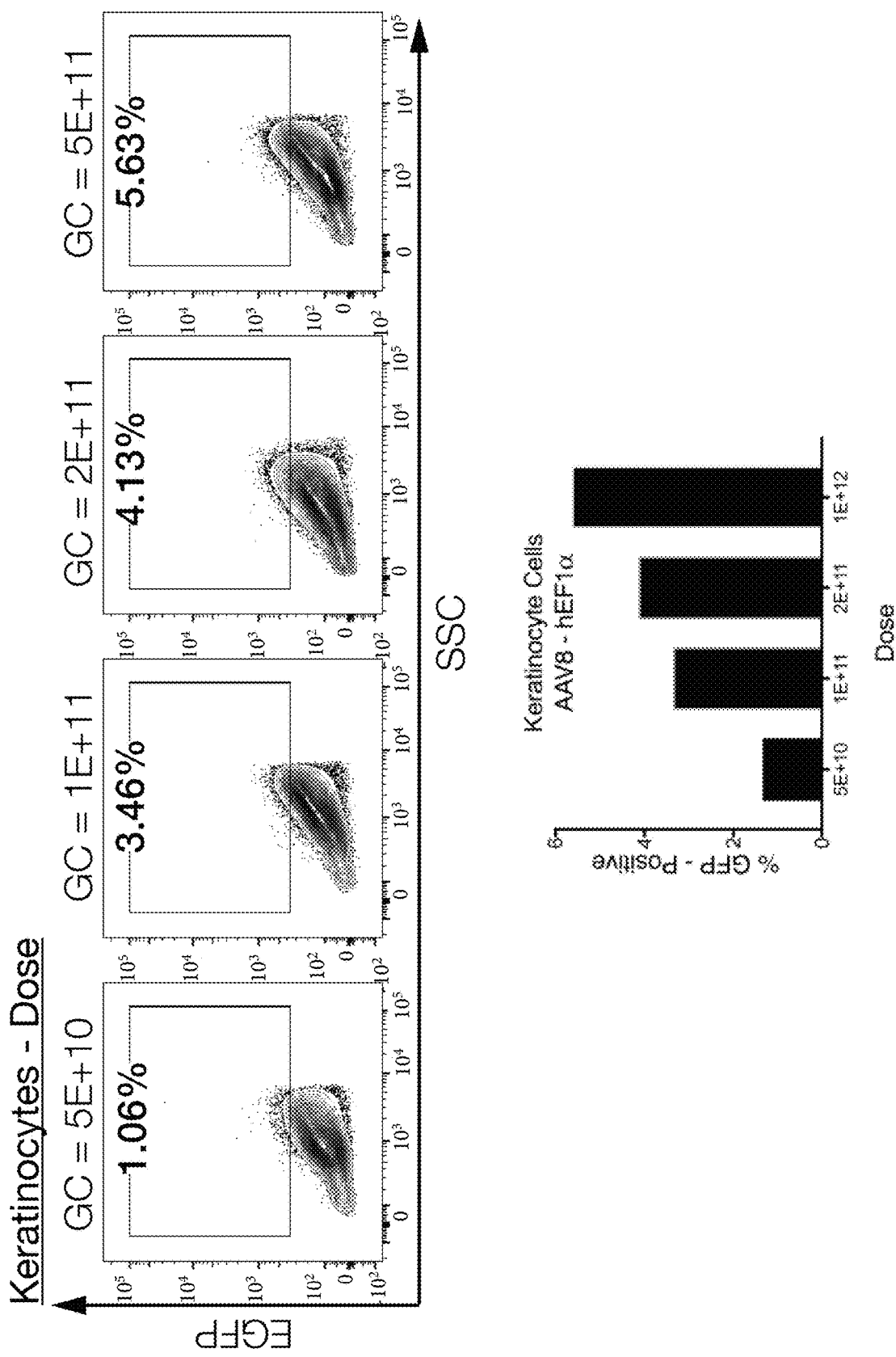

The expression potential of recombinant AAV virus to infect and deliver genes to human epidermis was quantified by flow cytometry. Whole skin was permeabilized using topical ultrasonic treatment, after which it was spot-treated with therapy. In one instance, skin explants (from human donor id=4 of medium age) were AAV-treated with hybrid serotypes of AAV2/2, AAV2/5, AAV2/6.2 AAV2/8, AAV2/9, and AAV2/10 at a dose of 2E+11 GC per explant, and cultured for 12 days. All vectors were driven by the hEF1a promoter. The epidermis of the explants was separated from the dermis using an overnight protease treatment (dispase II at 5 U/ml), and keratinocyte cells were dissociated with Trypsin-EDTA (0.25%) for 15 min at 37 C. The dissociated cells were stained with an anti-EGFP antibody and quantified for expression of GFP. As shown in FIG. 10A, AAV2/5 provided the highest GFP signal and the most robust expression of 22.4% in total epidermal keratinocyte cells. In another instance, the efficacy potential of CMV, CASI, shEF1a, and hEF1a promoters was evaluated using AAV2/2 at a dose of 2E+11 GC per explant. hEF1 a, CMV, shEF1a (truncated version) presented comparable efficiencies (FIG. 10B). Dose dependency response was evaluated using AA8-hEF1a from 5E+10 to 5E+11 GC per explant. As seen on FIG. 10C, dose response did not yield a linear response in the epidermis.

Example IV

Optimization of Gene Transfer to Human Skin Stem and Progenitor Cells

Figure 11A:
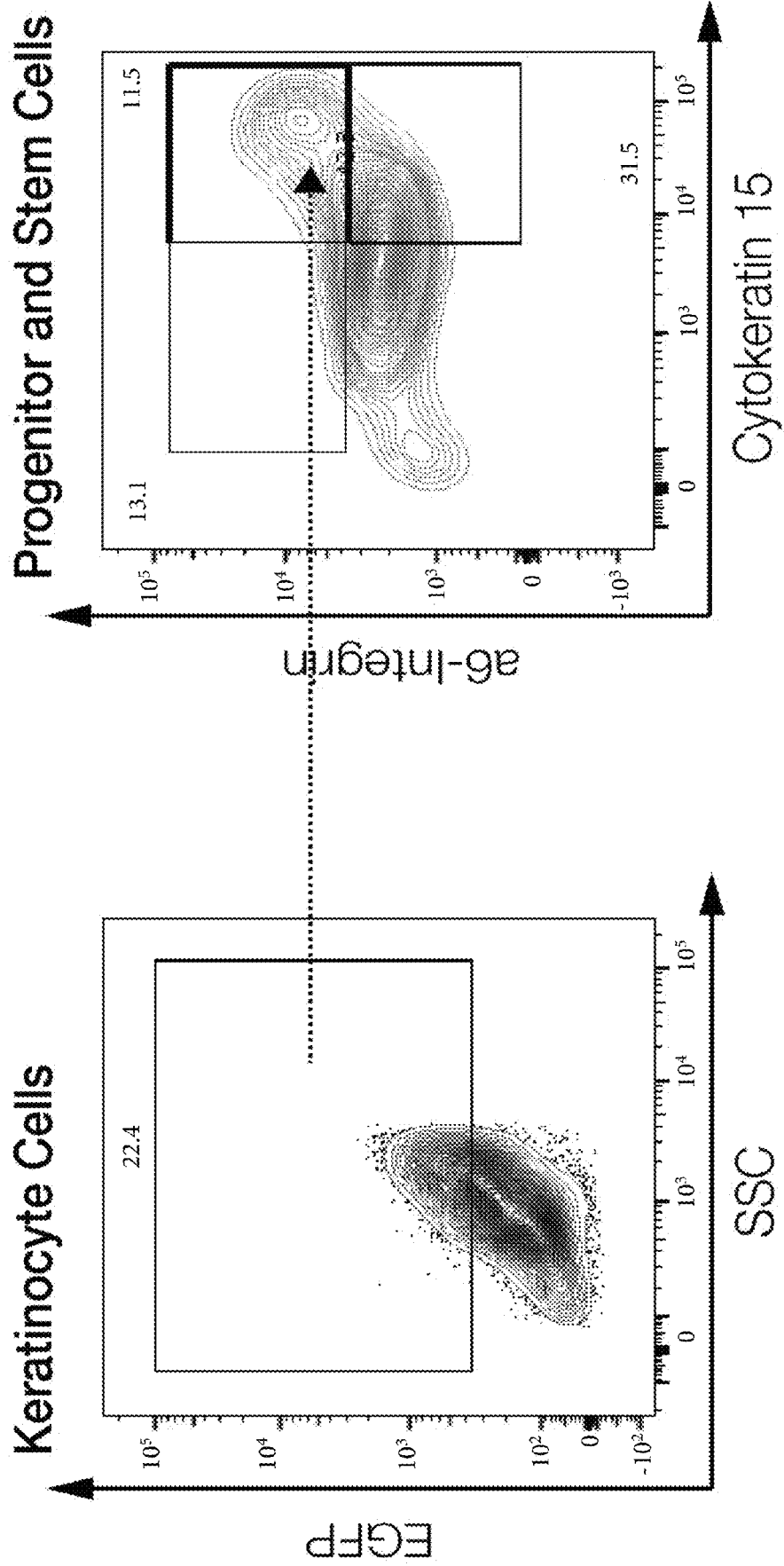
Figure 11D:
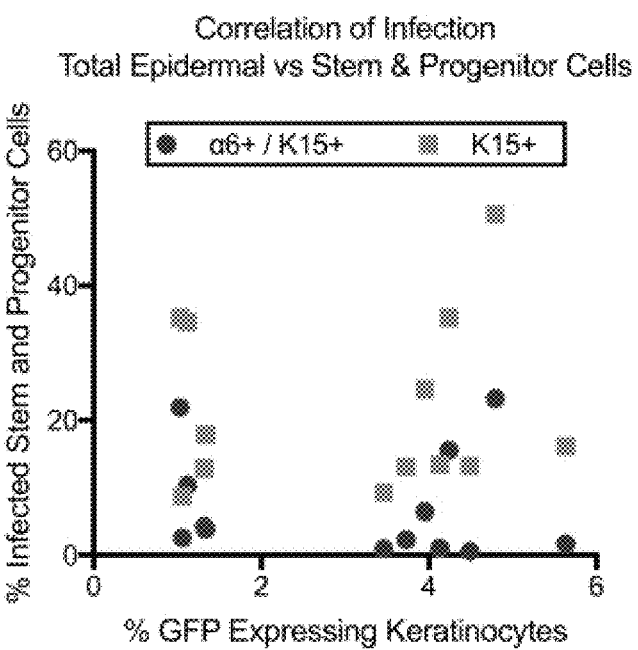

Skin is maintained through a balance of proliferation, differentiation, and self-renewal of stem cells that take place during normal tissue homeostasis or tissue repair. The epidermis relies on a population of stem cells and proliferating progenitors to continuously maintain its barrier-protective function. While the epidermal differentiated population (mature keratinocytes) has a lifespan of ~4 weeks, the stem and progenitor cell populations have a nearly life-long span.
To achieve long-term expression of genes in skin tissues, gene transfer to the populations of stem cells located within the basal membrane (slow cycling stem cells and their transiently amplifying progenitors) was optimized. As shown in FIG. 11A, the differentiated keratinocyte population was further analyzed for therapy efficacy towards progenitor stem cells expressing markers either for Cytokeratin 15, a6-Integrin, or both. Based on their ability to infect progenitor and stems cells, the top 5 most efficacious AAV-serotypes measured by GFP and K15 signal are listed in FIG. 11B. In the K15+ progenitor and stem cell populations, AAV2/2 and AAV2/5 presented with 50.6% and 42.5% infectivity efficiency, respectively.
Across all examined viral vectors, the ones with the highest infectivity capacity in the epidermal progenitor and stem cell populations expressing K15 and a6-integrin were AAV2/2-hEF1a, AAV2/2-CASI, AAV2/2-CMV, AAV2/5-hEF1a, and AAV2/8-hEF1a. As shown in FIG. 11C, the best performing vector AAV2/2-hEF1a which stained for 50.6% K15, stained for 23.2% of K15 and a6-integrin, while AAV2/5-hEF1a (42.5% K15) showed 11.5% signal for K15 and a6-integrin. Both AAV2/2 and AAV2/5 serotypes, driven by hEF1a promoter presented with high infectivity towards epidermal stem and progenitor cells, but AAV2/5 presented with higher infectivity towards differentiated keratinocytes. The correspondence between % GFP-positive epidermal cells and % GFP-positive stem and progenitor cells was mapped in FIG. 11D, and no correlation was determined between total capacity of infection, and stem cell capacity of infectivity.

Example V

Ex Vivo Human Expression and Systemic Production of Cytokine Transgenes

Figure 12A:
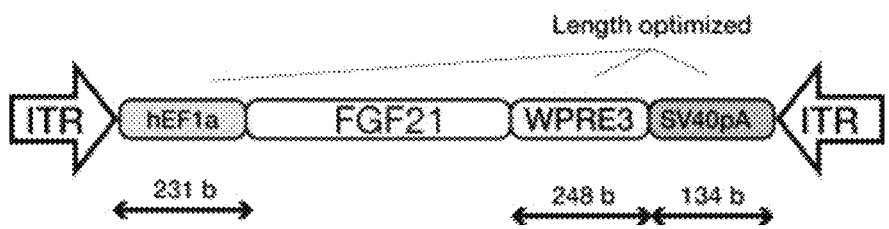
FIGS. 12A-12B show results of human expression and systemic production of cytokine transgenes according to certain embodiments of the disclosure.
Figure 12B:
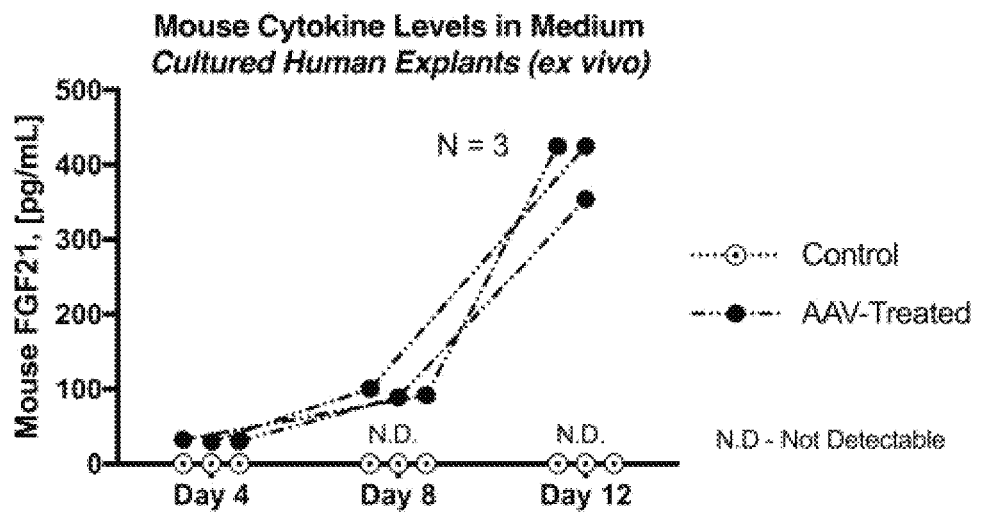

To confirm that the described optimizations to improve delivery of transgenes to human skin hold true for transgenes encoding secreted proteins, a well-studied gene involved with glucose metabolism—the mouse version of fibroblast growth factor 21 (FGF21) was expressed from a length optimized expression vector carrying truncated versions of hEF1a promoter, WPRE3 and SV40L poly(A) elements, as illustrated in FIG. 12A. Recombinant AAV virus with the capsid of serotype 8 (AAV2/8) was topically delivered to ultrasonically-permeabilized human skin explants at a dose of 2E+11 GC each. Skin pieces were cut with a 1.2 cm-punch biopsy and cultured for 12 days. The explant culture system was designed in such way that the dermal (bottom) surface of the tissue is positioned on a Biopore™ (PTFE) membrane cell strainer with the epidermis (the top) facing up. The dermis was kept a constant contact with the growth medium while the epidermis is exposed to air. This allowed for a proper proliferation and differentiation of the keratinocytes (as in vivo) and mimics a contact of the dermis with the circulation. Cell culture medium was sampled at three time points—days 4, 8 and 12, and mouse FGF21-specific ELISA was used to quantify the amounts of secreted protein. Because mouse version of FGF21 was administered to human skin, there was no background signal detected in this assay. FIG. 12B is a plot of secreted FGF21 amounts as a function of time (N=3). FIG. 12B shows individual data point for each replicate, and a maximum of 425 pg/mL secreted protein was reached at day 12.

Example VI

In Vivo Mouse Expression and Systemic Production of Cytokine Transgenes

Figure 13A:
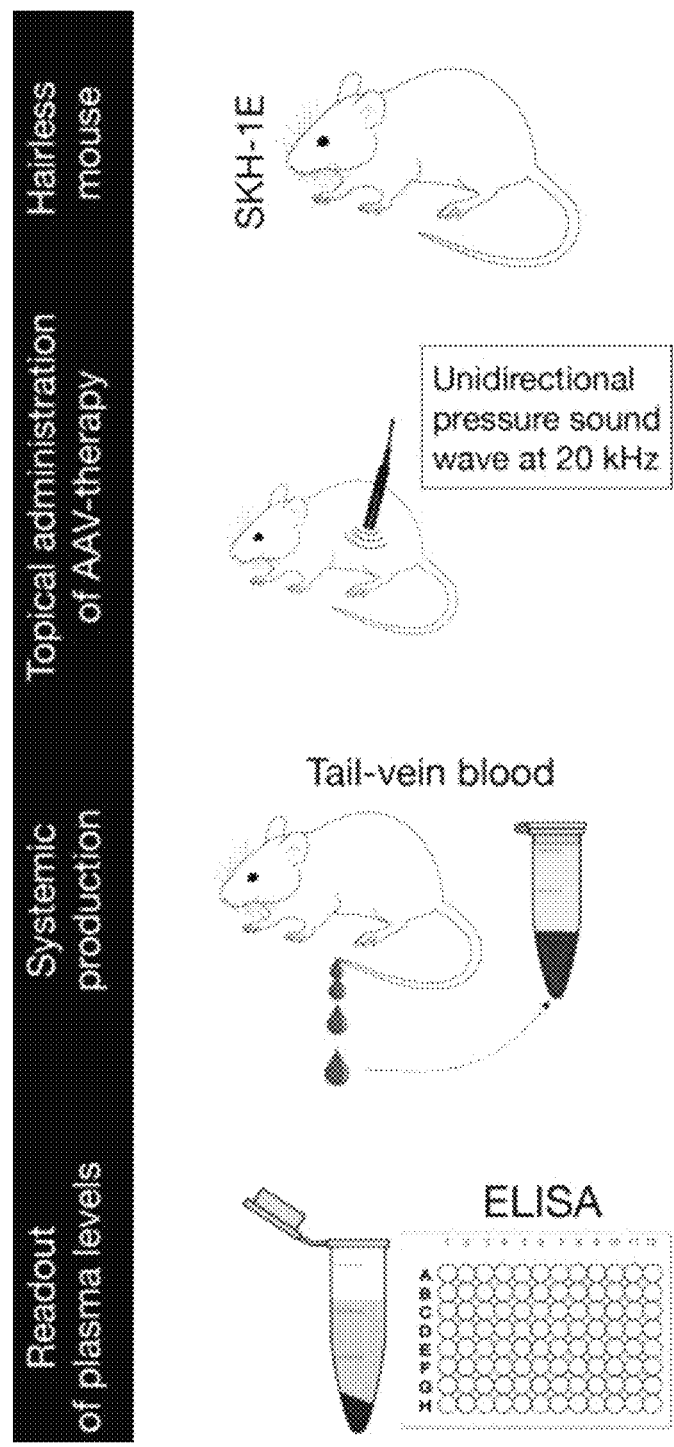
FIGS. 13A-13B show in vivo mouse expression and systemic production of cytokine transgenes.
Figure 13B:
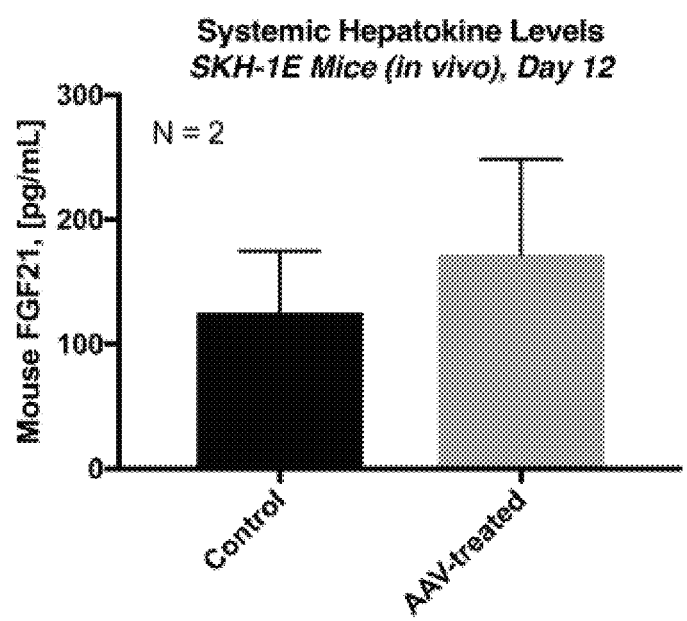

FIG. 13A is a workflow for in vivo gene transfer to mouse skin which involves permeabilization of mouse skin by low frequency ultrasound, application of recombinant AAV, sampling of systemic levels for a biologic molecule encoded by the expression vector, and analysis of protein amounts by ELISA. Recombinant AAV2/8 virus that expresses mouse FGF21 driven from a short hEF1a promoter administered to 5 mm-dia skin patch of hairless mouse skin (strain SKH-1E) at a dose of 2E+11 GC per animal. Within 12 days, increased amounts of FGF21 in the blood over the native levels were detectable, and reached a maximum of 248 pg/mL. FIG. 13B shows mean levels with standard error for 2 biological replicates (N=2).

Example VII

In Vivo Mouse Expression of Immune-Modulating Interferon-Gamma

Figure 14A:
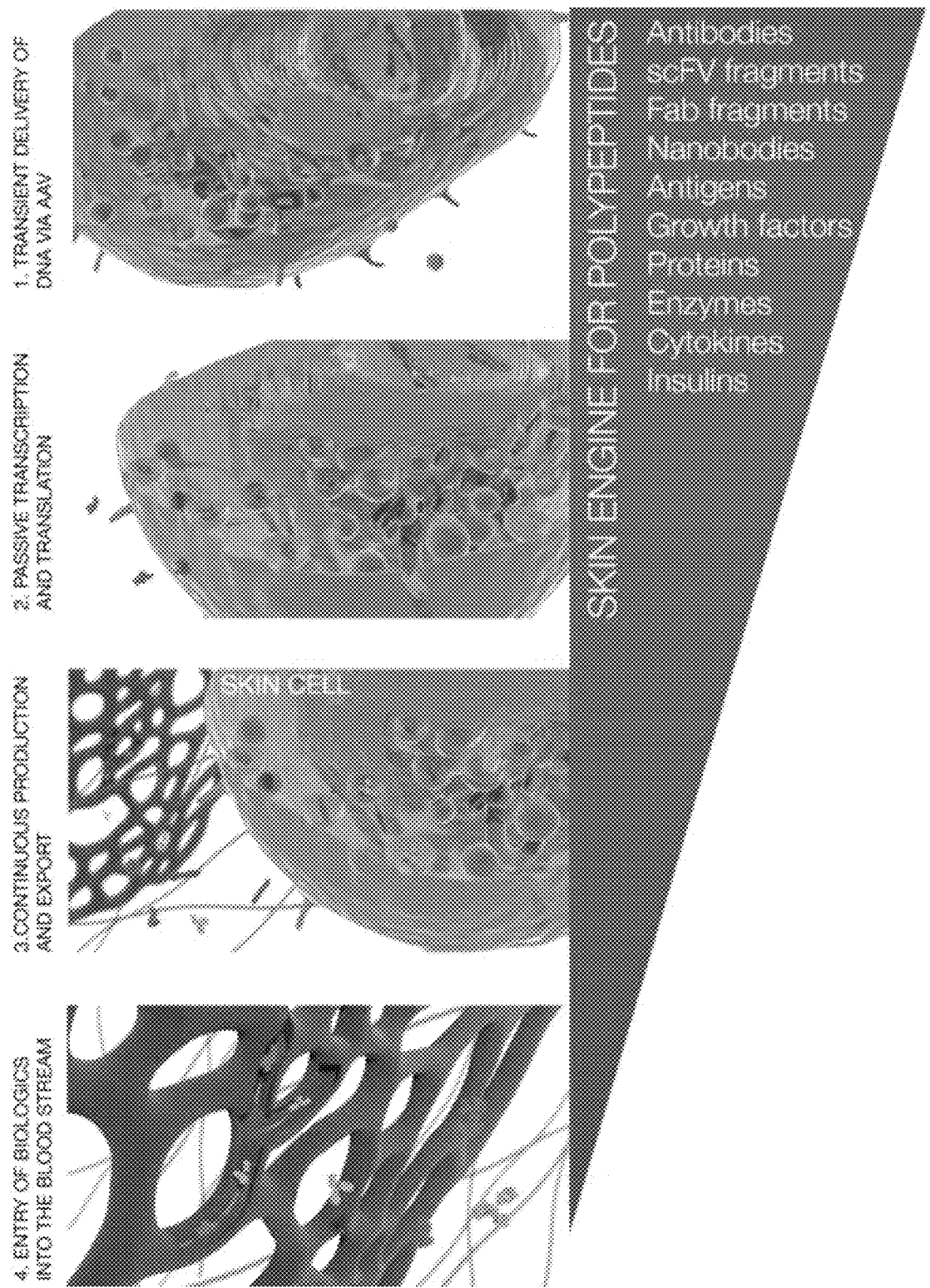
FIGS. 14A-14C show in vivo mouse expression of immunomodulating interferon-gamma.
Figure 14B:
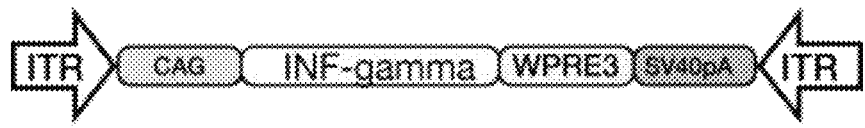
Figure 14C:
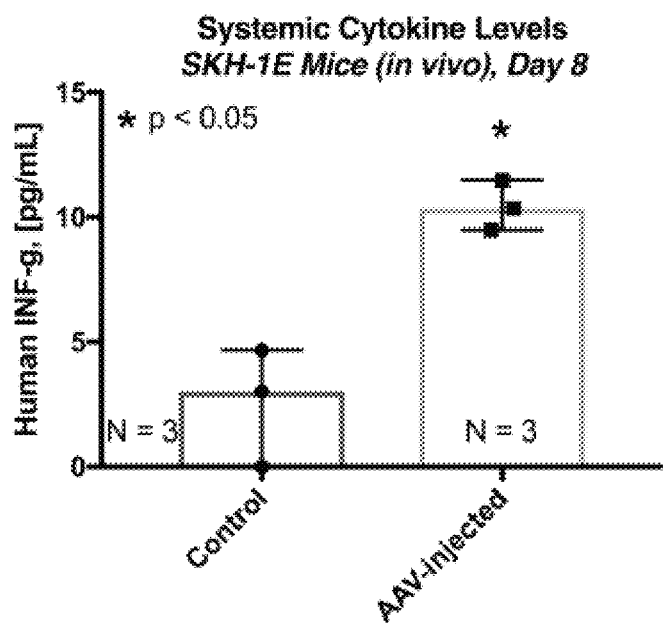

The process by which immune-modulating molecules are made by the skin's bio-machinery is illustrated in FIG. 14A. The described example employs a virtual patch of living skin to be used for the passive production of immune-modulating molecules, bypassing the natural immune response and forcing production of a class of interferons without utilizing a hematopoietic tissue. It illustrates a method for in vivo translation, production and secretion of INF-gamma directly to the blood stream of hairless mice. Recombinant AAV2/2 virus expressing unmodified sequence for human INFG gene was produced (FIG. 14B). A single dose of 2E+11 GC per animal was administered using ultrasonic skin permeabilization on the skin of a hairless mouse (strain SKH-1E). Blood samples collected from the mouse tail vein were quantified by human-specific INF-gamma ELISA as shown on FIG. 14C. Significant expression above 10 pg/mL was observed on day 8. FIG. 14C shows mean, standard error, and individual data points for each animal (N=3).

Example VIII

In Vivo Mouse Expression of Antibody Transgenes

Figure 15A:
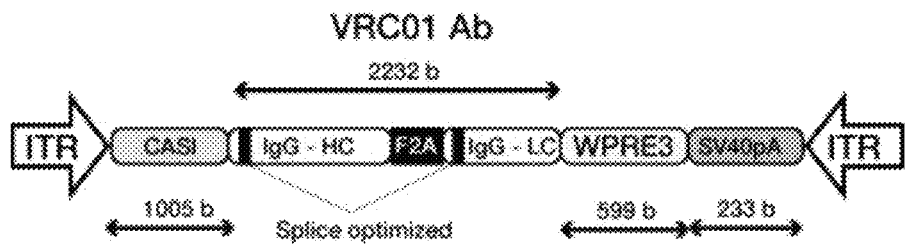
FIGS. 15A-15B show in vivo mouse expression of antibody transgenes.

The heavy and light chains of a commonly used HIV broadly neutralizing antibody (bnAb), VRC01 were separated by an F2A self-processing peptide sequence driven by a CASI promoter, and followed by WPRE3 and SV40 poly(A) elements. The sequence used for VRC01 was splice optimized, i.e. potential splice donor/acceptor sequences were removed and conservative to the codon mutations were used. FIG. 15A is a schematic of the used vector for expression of VRC01 bnAb.

Figure 15B:
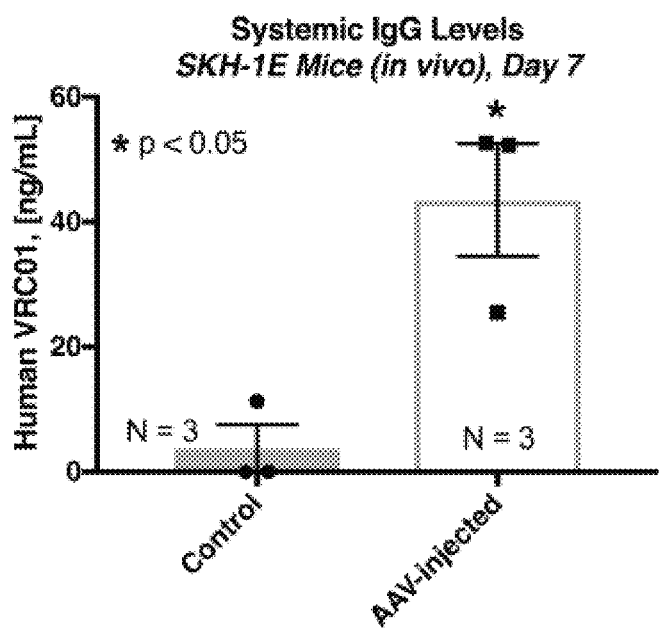

Recombinant AAV virus with the capsid of AAV2 that expresses VRC01 was topically administered to a single 5 mm-dia skin patch of hairless mice (strain SKH-1E) at a dose of 2E+11 GC per animal. Systemic antibody levels of VRC01 started to rise within one week, and were significantly elevated on day 7. Antibody levels were quantified using gp120-specific ELISA from blood serum. FIG. 15B shows that systemic antibody production reaches as high as 53 ng/mL of VRC01 and mean levels are significantly elevated for N=3.

Example IX

Ultraclean Production and Purification of Recombinant AAV

Figure 16A:
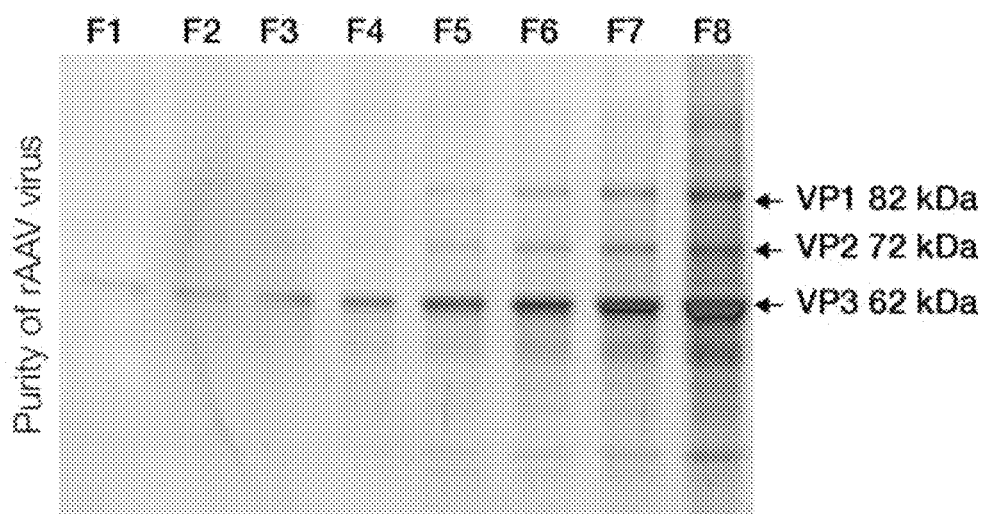
FIGS. 16A-16B show the results of ultraclean production and purification of rAAV according to certain embodiments of the disclosure.
Figure 16B:
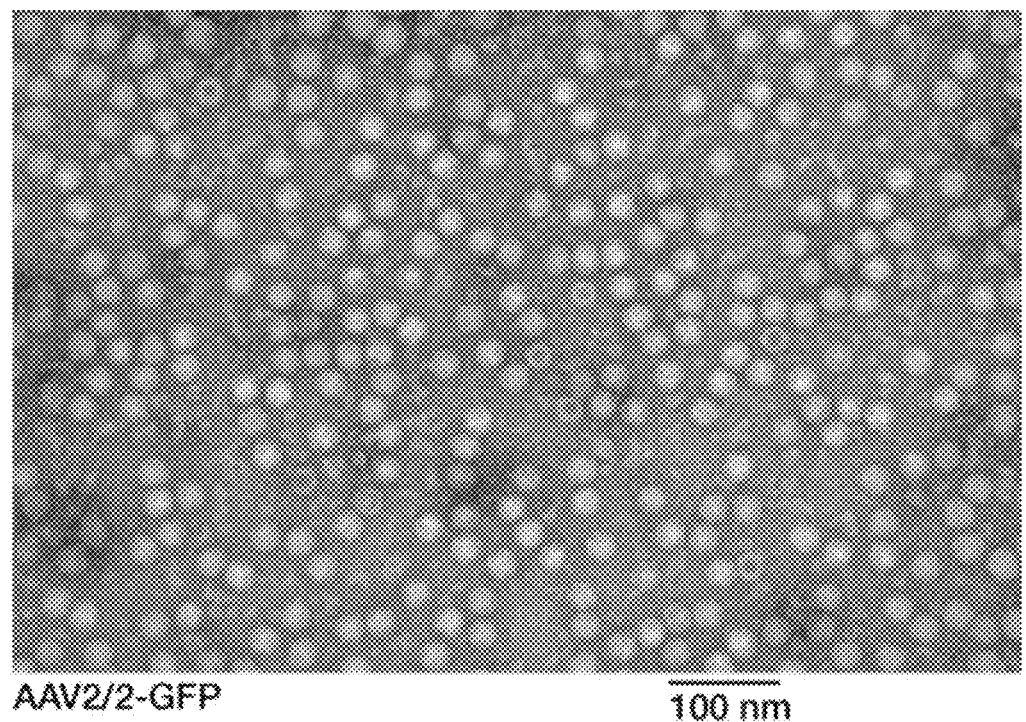

HEK293T Cells (ATCC) were expanded in DMEM (Corning) with 10% FBS (Genessee) and 1% Pen/Strep (Life) and cultured on 5-Layer Flasks (Corning) until 70-80% confluent. On Day 0, helper plasmid, capsid plasmid, and transgene ITR plasmid were combined with PEI Max (Polysciences) in a triple plasmid transfection. On Day 3, additional complete media was added to the culture (50% of original volume). On Day 6, NaCl was added to each flask to a final concentration of 0.5M and incubated for 2 hours. Lysed and dissociated cells were then collected and stored overnight at 4 C. On Day 7, the supernatant of the cell lysate was collected and 0.22 µM sterile filtered before addition of PEG 8000 (Calbiochem) to a final concentration of 8% and left at 4 C overnight on a stirplate. On Day 8, PEG mixture was centrifuged at 4000 G for 20 minutes. Supernatant was discarded, and pellet resuspended with PBS to a final volume of 8 mL. Benzonase (Millipore) was added and incubated at 37 C for 45 minutes. An ultracentrifuge gradient in optiseal tubes (Beckman-Coulter) was then created by layering resuspended PEG pellet, then 15%, 25%, 40%, and 60% iodixanol (Sigma) from the bottom-up. Samples were then balanced before ultracentrifugation at 240,000 G for 1 hour. Tubes were then punctured on the bottom before collecting 500 µL fractions, stopping at the 40-25% interface. Samples were run on a protein gel and fractions with high VP protein purity (FIG. 16A), after which pooled and concentrated using Amicon 100 kDa spin filters (Millipore). PBS with 5% sorbitol and 0.001% Pluronic F68 (Gibco) was added to each tube before an additional spin to wash virus. Concentrated and washed virus was then titered via probe-based qPCR against the WPRE3 region on the capsid. The quality of the virus was visually inspected using transmission electron microscopy, and it was determined that more than 95% of the viral capsids were fully packaged, as shown FIG. 16B for AAV2/2 expressing EGFP.

Example X

Virtual Therapeutic Skin Patch

Figure 17A:
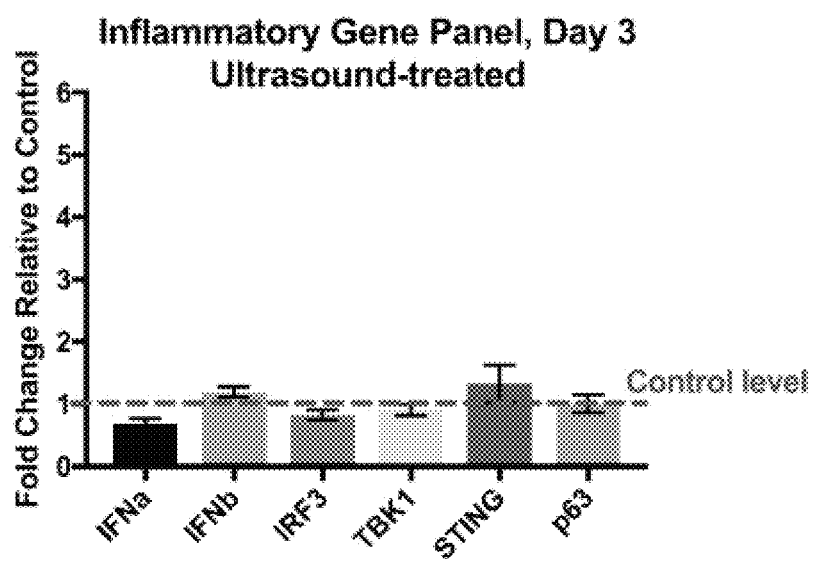
FIGS. 17A-17B show an inflammatory panel at Day 3 and Day 8, respectively, run on epidermal cells dissociated from human skin explants after treatment with rAAV-GFP therapy via ultrasound. At Day 3 (FIG. 17A), no inflammatory response above the baseline levels was detected, while at Day 8 (FIG. 17B) a minor transient response was observed as evidenced by slightly increased gene expression levels of Interferon alpha-1 (INFa1) and Interferon beta-1 (INFb1).
Figure 17B:
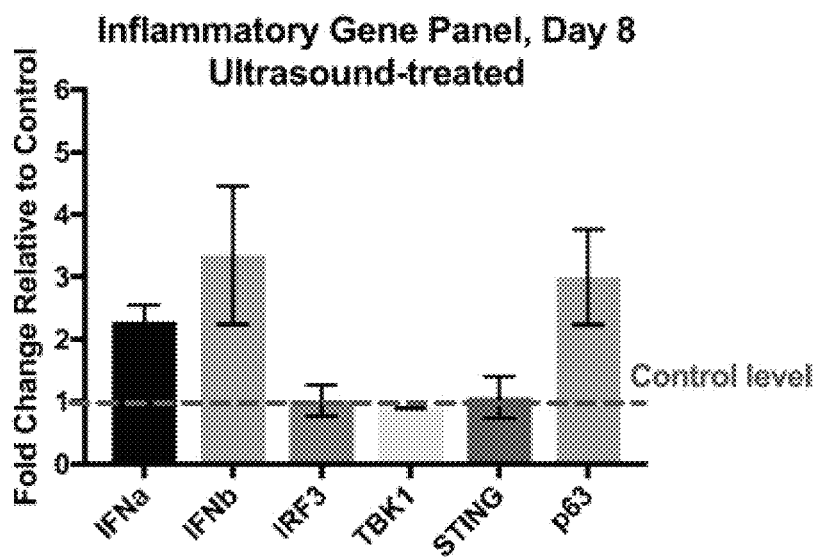

This example illustrates the therapeutic use of genetically engineered skin patch for in vivo immunomodulation, immunoprophylaxis, and passive delivery of therapies for diseases such as cancers, autoimmune diseases, metabolic disorders and viral infections. The virtual therapeutic skin patch is primed with transgenes serving preventative or therapeutic use by non-invasive delivery of recombinant AAV virus whose penetration to the epidermal and dermal layers is enabled by topical cavitational, low-frequency ultrasound method. Ultrasonic disruption of the stratum corneum is reversible and facilitates rAAV transport into the epidermis, the papillary and reticular dermis avoiding injury and inflammation of the treated and surrounding tissues. FIG. 17 shows an inflammatory panel at Day 3 and Day 8, respectively, run on epidermal cells dissociated from human skin explants after treatment with rAAV-GFP therapy via ultrasound. At Day 3 (FIG. 17A), no inflammatory response above the baseline levels was detected, while at Day 8 (FIG. 17B) a minor transient response was observed as evidenced by slightly increased gene expression levels of Interferon alpha-1 (INFa1) and Interferon beta-1 (INFb1). However, no acute innate response to the virus was detected as visible from the stable levels of Interferon regulatory factor 3 (IRF3), Serine/threonine-protein kinase (TBK1), and Stimulator of interferon genes protein (STINK). Moderately elevated levels of Tumor protein P63 (p63) is indicative of normal cell proliferation activity in the keratinocyte population.

The contents of all references, patents and published patent applications cited throughout this application are hereby incorporated by reference in their entirety for all purposes.

Other Embodiments

Other embodiments will be evident to those of skill in the art. It should be understood that the foregoing description is provided for clarity only and is merely exemplary. The spirit and scope of the present invention are not limited to the above examples, but are encompassed by the following claims. All publications and patent applications cited above are incorporated by reference in their entirety for all purposes to the same extent as if each individual publication or patent application were specifically and individually indicated to be so incorporated by reference.

APPENDIX A 1. (SEQ ID NO: 1) COL1A1 chimeric DNA, Collagen Type I Alpha 1 Chain

```
   1 cccacgcgtc cggactagtt ctagatcgcg agcggccggg agttggggcg ccttgccccg
  61 ggccccccag catgaagacc ccggcggaca cagggtttgc cttcccagat tgggcctaca
 121 aaccggagtc atccctggc tccaggcaga tccagctgtg cactttatc ctggagctgc
 181 ttcggaaaga ggagtaccag ggcgtcatcg cttggcaggg ggactacggg gagtttgtca
 241 tcaaggaccc tggtgaacct ggcgagcctg gcggttcagg tccaatgggt ccccgaggtc
 301 cccctggccc tcctggcaag aatggagatg atgggaagc tggcaagccc ggccgtcctg
 361 gtgagcgtgg acctcctgga cctcaggggt ctcgtggatt gcctggaaca gctggcctcc
 421 ctggaatgaa gggacaccga ggcttcagtg gtttggatgg tgccaaagga gatgctggtc
 481 ctgctggtcc taagggagag cccggcagtc ctggtgaaaa cggagctcct ggccagatgg
 541 gtccccgagg tctgcccggt gagagaggtc gccctggacc tcctggcact gctggtgctc
 601 gcggtaacga tggtgctgtt ggtgctgctg accccctggt cccaccggc cccactggcc
 661 ctcctggctt ccctggtgca gttggtgcta agggtgaagc tggtccccaa ggagctagag
 721 gctctgaagg tccccagggt gtgcgtggt agcccggacc ccctggcct gctggtgctg
 781 ccggccctgc tggaaaccct ggtgctgatg acaacctgg cgctaaaggt gccaatggtg
 841 ctcctggtat tgctggtgct cctggcttcc ctggtgccg aggccctct ggaccccagg
 901 gccccagcgg ccctccaggt cccaaggta acagtggtga acctggtgct cctggcaaca
 961 aaggagacac tggtgccaaa ggagaacccg tgctactgg agttcaaggt ccccaggcc
1021 ctgccggaga agaaggaaaa cgaggagccc gtggtgagcc tggaccttcc ggactgcctg
1081 gacctcctgg cgagcgtggt ggacctggta gccgtggttt ccctggtgct gatggtgttg
1141 ctggccccaa gggtcttcc ggtgaacgtg gtgctcccgg acctgctggt cccaaaggtt
1201 ctcctggtga agctggtcgc cccggtgaag ctggtctccc tggtgccaag gtctcactg
1261 gcagtcctgg cagccctggt cctgatggca aaaccggccc ccctggtccc gctggtcaag
1321 atggtcgccc tggacccgca ggtcctcctg gagcccgtgg ccaggctggt gtgatgggat
1381 tccctggacc taagggtacc gctggagaac tggaaggc tggagagcga ggccttcccg
1441 gaccccctgg cgctgttggt cctgctggca agatggaga agctggagct cagggagccc
1501 ctggccctgc tggtcctgct ggtgagagag gtgaacaagg tcccgctggc tcccctggat
1561 tccagggtct tcctggtcct gccggtcctc ctggtgaagc aggcaagcct ggtgaacagg
1621 gtgttcctgg agaccttggt gcccctggac cctctggcgc aagaggcgag agaggtttcc
1681 ctggtgaacg tggtgtacaa ggtccccag gtcctgctgg tccccgagga aacaatggtg
1741 cccccggcaa cgatggtgcc aagggtgata ctggtgcccc cggagctccc ggtagccagg
1801 gtgcccccgg tcttcaggga atgcctggtg aacgtggtgc agctggtctt ccaggtccta
1861 agggtgacag aggtgatgct ggtcccaaag tgctgatgg ttctcctggt aaagatggtg
1921 cccgtggtct gactggtccc attggtcctc ctggccctgc tggtgcccct ggtgacaagg
1981 gtgaagctgg tcccagtggt cctccggtc ccaccggagc cgtggtgct cccggagacc
2041 gtggtgaggc tggtccccct ggtcctgctg gctttgccgg ccccctggt gctgatggcc
2101 aacctggtgc gaaaggtgaa cctggtgata ctggtgttaa aggtgatgct ggtcctcctg
2161 gccctgctgg tcctgctgga cccccggcc ccattggtaa cgttggtgct cctggaccca
2221 aaggtcctcg tggtgctgct ggtcccctg gtgctactgg cttcctggt gctgctggcc
2281 gtgtcggtcc ccctggtccc tctggaaatg ctggacccc tggccctccc ggtcccgttg
```

-continued

```
2341  gcaaagaagg gggcaaaggt ccccgtggtg agactggccc tgctggacgt cctggtgaag
2401  ttggtccccc aggtccccccc ggtcctgctg gtgagaaagg atctcctggt gctgatggac
2461  ctgctggctc tcctggtacc cctggacctc agggtattgc tggacaacgt ggtgtggtcg
2521  gtcttcccgg tcagagagga gaaagaggct tccctggtct tcctggcccc tctggtgaac
2581  ctggcaaaca aggtccttct ggatcaagtg gtgaacgcgg tccccctggc cccatggggc
2641  cccctggatt ggctggtccc cctggtgaat ctggacgtga gggatccccc ggtgctgaag
2701  gctcccctgg aagggatggt gctcccgggg ccaagggtga ccgtggtgag actggccctg
2761  ctggcccccc tggtgcccct ggtgctcccg gtgctcccgg ccctgttggt cccgctggca
2821  agaatggcga tcgtggtgag actggtcctg ctggtcctgc tggtcccatt ggccctgctg
2881  gtgcccgtgg ccctgctgga ccccaaggcc ccgtggtga caagggtgag acaggcgaac
2941  aaggtgacag aggcataaag ggtcatcgtg gcttctctgg tctccagggt cctcctggtt
3001  ctcctggttc tcctggtgaa caaggcccct ctggagcttc aggtcctgca ggccccgggg
3061  gtccccctgg ctctgctggt tctcctggca agacggact caacggtctc ctggccccca
3121  ttggtccccc tggtcctcga ggtcgcactg gtgacagcgg ccctgctggt cccccggcc
3181  ctcctggacc ccctggccct cctggacctc ccagtggcgg ttatgacttc agcttcctgc
3241  ctcagccacc tcaagagaag tctcaagatg gtggccgcta ctaccgggcc gatgatgcta
3301  acgtggttcg tgaccgtgac cttgaggtgg acaccaccct caagagcctg agtcagcaga
3361  ttgagaacat ccgcagcccc gaaggcagcc gcaagaaccc tgcccgcaca tgccgcgacc
3421  tcaagatgtg ccactctgac tggaagagcg gagagtactg gatcgaccct aaccaaggct
3481  gcaacctgga cgccatcaag gtctactgca acatggagac aggtcagacc tgtgtgttcc
3541  ctactcagcc gtctgtgcct cagaagaact ggtacatcag cccgaacccc aaggaaaaga
3601  agcacgtctg gtttggagag agcatgaccg atggattccc gttcgagtac ggaagcgagg
3661  gctccgaccc cgccgatgtc gctatccagc tgaccttcct gcgcctaatg tccaccgagg
3721  cctcccagaa catcacctat cactgcaaga acagcgtagc ctacatggac cagcagactg
3781  gcaacctcaa gaaggccctg ctcctccagg gatccaacga gatcgagctc agaggcgaag
3841  gcaacagtcg cttcacctac agcaccccttg tggacggctg cacgagtcac accggaactt
3901  ggggcaagac agtcatcgaa tacaaaacca ccaagacctc ccgcctgccc atcatcgatg
3961  tggctccctt ggacattggt gccccagacc aggaattcgg actagacatt ggccctgcct
4021  gcttcgtgta aactccctcc accccaatct ggttccctcc cacccagccc acttttcccc
4081  aaccctggaa acagacgaac aacccaaact caatttcccc caaaagccaa aaatatggga
4141  gataatttca catggacttt ggaaaacatt ttttttcctt tgcattcacc tttcaaactt
4201  agttttttacc tttgaccaac tgaacgtgac caaaaaccaa aagtgcattc aaccttacca
4261  aaaagaaaa aaaaaaaga ataaataaat aactttttaa aaaggaaaa aaaaaaaaa
4321  a
```

2. (SEQ ID NO: 2) COL3A1 human DNA, Collagen Type III Alpha 1 Chain

```
  1  ccacgcgtcc ggacgggccc ggtgctgaag ggcagggaac aacttgatgg tgctactttg
 61  aactgctttt cttttctcct ttttgcacaa agagtctcat gtctgatatt tagacatgat
121  gagctttgtg caaaagggga gctggctact tctcgctctg cttcatccca ctattatttt
181  ggcacaacag gaagctgttg aaggaggat ttcccatctt ggtcagtcct atgcggatag
241  agatgtctgg aagccagaac catgccaaat atgtgtctgt gactcaggat ccgttctctg
```

-continued

```
 301 cgatgacata atatgtgacg atcaagaatt agactgcccc aacccagaaa ttccatttgg
 361 agaatgttgt gcagtttgcc cacagcctcc aactgctcct actcgccctc ctaatggtca
 421 aggacctcaa ggccccaagg gagatccagg ccctcctggt attcctggga gaaatggtga
 481 ccctggtatt ccaggacaac cagggtcccc tggttctcct ggcccccctg gaatctgtga
 541 atcatgccct actggtcctc agaactattc tccccagtat gattcatatg atgtcaagtc
 601 tggagtagca gtaggaggac tcgcaggcta tcctggacca gctggccccc caggccctcc
 661 cggtcccsct ggtacatctg gtcatcctgg ttccctgga tctccaggat accaaggacc
 721 ccctggtgaa cctgggcaag ctggtccttc aggccctcca ggacctcctg gtgctatagg
 781 tccatctggt cctgctggaa agatggagaa tcaggtaga cccggacgac ctggagagcg
 841 aggattgcct ggacctccag gtatcaaagg tccagctggg atacctggat tccctggtat
 901 gaaaggacac agaggcttcg atggacgaaa tggagaaaag ggtgaaacag gtgctcctgg
 961 attaaagggt gaaaatggtc ttccaggcga aatggagct cctggaccca tgggtccaag
1021 aggggctcct ggtgagcgag acggccagac acttcctggg gctgcaggtg ctcggggtaa
1081 tgacggtgct cgaggcagtg atggtcaacc aggccctcct ggtcctcctg gaactgccgg
1141 attccctgga tcccctggtg ctaagggtga agtggacct gcagggtctc tggttcaaa
1201 tggtgcccct ggacaaagag gagaacctgg acctcaggga cacgctggtg ctcaaggtcc
1261 tcctggccct cctgggatta atggtagtcc tggtggtaaa ggcgaaatgg gtcccgctgg
1321 cattcctgga gctcctggac tgatgggagc ccggggtcct ccaggaccag ccggtgctaa
1381 tggtgctcct ggactgcgag gtggtgcagg tgagcctggt aagaatggtc caaaggaga
1441 gcccggacca cgtggtgaac gcggtgaggc tggtattcca ggtgttccag gagctaaagg
1501 cgaagatggc aaggatggat cacctgagaa acctggtgca aatgggcttc caggagctgc
1561 aggagaaagg ggtgcccctg ggttccgagg acctgctgga ccaaatggca tcccaggaga
1621 aaagggtcct gctggagagc gtggtgctcc aggccctgca gggcccagag gagctgctgg
1681 agaacctggc agagatggcg tccctggagg tccaggaatg aggggcatgc ccggaagtcc
1741 aggaggacca ggaagtgatg ggaaaccagg gcctcccgga agtcaaggag aaagtggtcg
1801 accaggtcct cctgggccat ctggtccccg aggtcagcct ggtgtcatgg gcttccccgg
1861 tcctaaagga atgatggtg ctcctggtaa gaatgaggaa cgaggtggcc ctggaggacc
1921 tggccctcag gtcctcctg gaaagaatgg tgaaactgga cctcagggac ccccagggcc
1981 tactgggcct ggtggtgaca aaggagacac aggaccccct ggtccacaag gattacaagg
2041 cttgcctggt acaggtggtc ctccaggaga aaatggaaaa cctggggaac caggtccaaa
2101 gggtgatgcc ggtgcacctg gagctccagg aggcaagggt gatgctggtg cccctggtga
2161 acgtggacct cctggattgg caggggcccc aggacttaga ggtggagctg gtccccctgg
2221 tccgaagga gaaaaggtg ctgctggtcc tctgggcca cctggtgctg ctggtactcc
2281 tggtctgcaa ggaatgcctg agaaagagg aggtcttgga agtcctggtc aaagggtga
2341 caagggtgaa ccaggcggtc caggtgctga tggtgtccca gggaaagatg cccaagggg
2401 tcctactggt cctattggtc tcctggccc agctggccag cctggagata agggtgaagg
2461 tggtgccccc ggacttccag gtatagctgg acctcgtggt agccctggtg agagaggtga
2521 aactggccct ccaggacctg ctggtttccc tggtgctcct ggacagaatg gtgaacctgg
2581 tggtaaagga gaaagagggg ctccgggtga gaaggtgaa ggaggccctc ctggagttgc
2641 aggacctcct ggcaaagatg gaaccagtgg acatccaggt cccattggac caccagggcc
```

-continued

```
2701  tcgaggtaac agaggtgaaa gaggatctga gggctcccca ggccacccag ggcaaccagg
2761  ccctcctgga cctcctggtg cccctggtcc ttgctgtggt ggtgttggag ccgctgccat
2821  tgctgggatt ggaggtgaaa aagctggcgg ttttgccccg tattatggag atgaaccaat
2881  ggatttcaaa atcaacaccg atgagattat gacttcactc aagtctgtta atggacaaat
2941  agaaagcctc attagtcctg atggttctcg taaaaacccc gctagaaact gcagagacct
3001  gaaattctgc catcctgaac tcaagagtgg agaatactgg gttgacccta accaaggatg
3061  caaattggat gctatcaagg tattctgtaa tatggaaact ggggaaacat gcataagtgc
3121  caatcctttg aatgttccac ggaaacactg gtggacagat tctagtgctg agaagaaaca
3181  cgtttggttt ggagagtcca tggatggtgg ttttcagttt agctacggca atcctgaact
3241  tcctgaagat gtccttgatg tgcagctggc attccttcga cttctctcca gccgagcttc
3301  ccagaacatc acatatcact gcaaaaatag cattgcatac atggatcagg ccagtggaaa
3361  tgtaaagaag gccctgaagc tgatggggtc aaatgaaggt gaattcaagg ctgaaggaaa
3421  tagcaaattc acctacacag ttctggagga tggttgcacg aaacacactg gggaatggag
3481  caaaacagtc tttgaatatc gaacacgcaa ggctgtgaga ctacctattg tagatattgc
3541  accctatgac attggtggtc ctgatcaaga atttggtgtg gacgttggcc ctgtttgctt
3601  tttataaacc aaactctatc tgaaatccca acaaaaaaaa tttaactcca tatgtgttcc
3661  tcttgttcta atcttgtcaa ccagtgcaag tgaccgacaa aattccagtt atttatttcc
3721  aaaatgtttg gaaacagtat aatttgacaa agaaaaatga tacttctctt ttttgctgt
3781  tccaccaaat acaattcaaa tgcttttgt tttattttt taccaattcc aatttcaaaa
3841  tgtctcaatg gtgctataat aaataaactt caacactctt tatgataaaa aaaaaaaaaa
3901  aa
```

APPENDIX B 3. (SEQ ID NO: 3) AAV2 ITR 5' ITR
CCTGCAGGCAGCTGCGCGCTCGCTCGCTCACTGAGGCCGCCCGGGCGTCGGCG
ACCTTTGGTCGCCCGGCCTCAGTGAGCGAGCGAGCGCGCAGAGAGGGAGTGGCC
AACTCCATCACTAGGGGTTCCT 4. (SEQ ID NO: 4) AAV2 ITR 3' ITR
CCTGCAGGCAGCTGCGCGCTCGCTCGCTCACTGAGGCCGCCCGGGCAAAGCCCG
GGCGTCGGGCGACCTTTGGTCGCCCGGCCTCAGTGAGCGAGCGAGCGCGCAGAG
AGGGAGTGGCCAACTCCATCACTAGGGGTTCCT 5. (SEQ ID NO: 5) AAV2 vector backbone; bold italicized underlined regions represent
ligation overhangs
_CTAGC_AATCAACCTCTGGATTACAAAATTTGTGAAAGATTGACTGGTATTCTTAA
CTATGTTGCTCCTTTTACGCTATGTGGATACGCTGCTTTAATGCCTTTGTATCATG
CTATTGCTTCCCGTATGGCTTTCATTTTCTCCTCCTTGTATAAATCCTGGTTAGTTC
TTGCCACGGCGAACTCATCGCCGCCTGCCTTGCCCGCTGCTGGACAGGGGCTCG
GCTGTTGGGCACTGACAATTCCGTGGTGTTTATTTGTGAAATTTGTGATGCTATTG
CTTTATTTGTAACCATTCTAGCTTTATTTGTGAAATTTGTGATGCTATTGCTTTATT
TGTAACCATTATAAGCTGCAATAAACAAGTTAACAACAACAATTGCATTCATTTT
ATGTTTCAGGTTCAGGGGGAGATGTGGGAGGTTTTTTAAAGCGGGGATCCAAA
TTCCCGATAAGGATCTTCCTAGAGCATCGCTACGTAGATAAGTAGCATGGCGGGT
TAATCATTAACTACAAGGAACCCCTAGTGATGGAGTTGGCCACTCCCTCTCTGCG
CGCTCGCTCGCTCACTGAGGCCGGGCGACCAAAGGTCGCCCGACGCCCGGGCTT
TGCCCGGGCGGCCTCAGTGAGCGAGCGAGCGCGCAGCCTTAATTAACCTAATTC
ACTGGCCGTCGTTTTACAACGTCGTGACTGGGAAAACCCTGGCGTTACCCAACTT
AATCGCCTTGCAGCACATCCCCCTTTCGCCAGCTGGCGTAATAGCGAAGAGGCCC
GCACCGATCGCCCTTCCCAACAGTTGCGCAGCCTGAATGGCGAATGGGACGCGC
CCTGTAGCGGCGCATTAAGCGCGGCGGGTGTGGTGGTTACGCGCAGCGTGACCG
CTACACTTGCCAGCGCCCTAGCGCCCGCTCCTTTCGCTTTCTTCCCTTCCTTTCTC
GCCACGTTCGCCGGCTTTCCCCGTCAAGCTCTAAATCGGGGGCTCCCTTTAGGGT
TCCGATTTACTGCTTTACGGCACCTCGACCCCAAAAAACTTGATTAGGGTGATGG

```
TTCACGTAGTGGGCCATCGCCCTGATAGACGGTTTTTCGCCCTTTGACGTTGGAG
TCCACGTTCTTTAATAGTGGACTCTTGTTCCAAACTGGAACAACACTCAACCCTA
TCTCGGTCTATTCTTTTGATTTATAAGGGATTTTGCCGATTTCGGCCTATTGTTA
AAAAATGAGCTGATTTAACAAAAATTTAACGCGAATTTTAACAAAATATTAACGT
TTATAATTTCAGGTGGCATCTTTCGGGGAAATGTGCGCGGAACCCCTATTTGTTT
ATTTTTCTAAATACATTCAAATATGTATCCGCTCATGAGACAATAACCCTGATAA
ATGCTTCAATAATATTGAAAAAGGAAGAGTATGAGTATTCAACATTTCCGTGTCG
CCCTTATTCCCTTTTTTGCGGCATTTTGCCTTCCTGTTTTTGCTCACCCAGAAACGC
TGGTGAAAGTAAAAGATGCTGAAGATCAGTTGGGTGCACGAGTGGGTTACATCG
AACTGGATCTCAATAGTGGTAAGATCCTTGAGAGTTTTCGCCCCGAAGAACGTTT
TCCAATGATGAGCACTTTTAAAGTTCTGCTATGTGGCGCGGTATTATCCCGTATTG
ACGCCGGGCAAGAGCAACTCGGTCGCCGCATACACTATTCTCAGAATGACITGG
TTGAGTACTCACCAGTCACAGAAAAGCATCTTACGGATGGCATGACAGTAAGAG
AATTATGCAGTGCTGCCATAACCATGAGTGATAACACTGCGGCCAACTTACTTCT
GACAACGATCGGAGGACCGAAGGAGCTAACCGCTTTTTTGCACAACATGGGGGA
TCATGTAACTCGCCTTGATCGTTGGGAACCGGAGCTGAATGAAGCCATACCAAA
CGACGAGCGTGACACCACGATGCCTGTAGTAATGGTAACAACGTTGCGCAAACT
ATTAACTGGCGAACTACTTACTCTAGCTTCCCGGCAACAATTAATAGACTGGATG
GAGGCGGATAAAGTTGCAGGACCACTTCTGCGCTCGGCCCTTCCGGCTGGCTGGT
TTATTGCTGATAAATCTGGAGCCGGTGAGCGTGGGTCTCGCGGTATCATTGCAGC
ACTGGGGCCAGATGGTAAGCCCTCCCGTATCGTAGTTATCTACACGACGGGGAG
TCAGGCAACTATGGATGAACGAAATAGACAGATCGCTGAGATAGGTGCCTCACT
GATTAAGCATTGGTAACTGTCAGACCAAGTTTACTCATATATACTTTAGATTGAT
TTAAAACTTCATTTTTAATTTAAAAGGATCTAGGTGAAGATCCTTTTTGATAATCT
CATGACCAAAATCCCTTAACGTGAGTTTTCGTTCCACTGAGCGTCAGACCCCGTA
GAAAAGATCAAAGGATCTTCTTGAGATCCTTTTTTTCTGCGCGTAATCTGCTGCTT
GCAAACAAAAAAACCACCGCTACCAGCGGTGGTTTGTTTGCCGGATCAAGAGCT
ACCAACTCTTTTTCCGAAGGTAACTGGCTTCAGCAGAGCGCAGATACCAAATACT
GTCCTTCTAGTGTAGCCGTAGTTAGGCCACCACTTCAAGAACTCTGTAGCACCGC
CTACATACCTCGCTCTGCTAATCCTGTTACCAGTGGCTGCTGCCAGTGGCGATAA
GTCGTGTCTTACCGGGTTGGACTCAAGACGATAGTTACCGGATAAGGCGCAGCG
GTCGGGCTGAACGGGGGGTTCGTGCACACAGCCCAGCTTGGAGCGAACGACCTA
CACCGAACTGAGATACCTACAGCGTGAGCTATGAGAAAGCGCCACGCTTCCCGA
AGGGAGAAAGGCGGACAGGTATCCGGTAAGCGGCAGGGTCGGAACAGGAGAGC
GCACGAGGGAGCTTCCAGGGGAAACGCCTGGTATCTTTATAGTCCTGTCGGGTT
TCGCCACCTCTGACTTGAGCGTCGATTTTTGTGATGCTCGTCAGGGGGGCGGAGC
CTATGGAAAAACGCCAGCAACGCGGCCTTTTTACGGTTCCTGGCCTTTTGCTGGC
CTTTTGCTCACATGTTCTTTCCTGCGTTATCCCCTGATTCTGTGGATAACCGTATT
ACCGCCTTTGAGTGAGCTGATACCGCTCGCCGCAGCCGAACGACCGAGCGCAGC
GAGTCAGTGAGCGAGGAAGCGGAAGAGCGCCCAATACGCAAACCGCCTCTCCCC
GCGCGTTGGCCGATTCATTAATGCAGCTGGCACGACAGGTTTCCCGACTGGAAA
GCGGGCAGTGAGCGCAACGCAATTAATGTGAGTTAGCTCACTCATTAGGCACCC
CAGGCTTTACACTTTATGCTTCCGGCTCGTATGTTGTGTGGAATTGTGAGCGGAT
AACAATTTCACACAGGAAACAGCTATGACCATGATTACGCCAGATTTAATTAAG
GCCTTAATTAGGCTGCGCGCTCGCTCGCTCACTGAGGCCGCCCGGGCAAAGCCCG
GGCGTCGGGCGACCTTTGGTCGCCCGGCCTCAGTGAGCGAGCGAGCGCGCAGAG
AGGGAGTGGCCAACTCCATCACTAGGGGTTCCTTGTAGTTAATGATTAACCCGCC
ATGCTACTTATCTACGTAGCCATGCTCTAGGAAGATCGGAATTCCTAGGCTCCGG
TGCCCGTCAGTGGGCAGAGCGCACATCGCCCACAGTCCCCGAGAAGTTGGGGGG
AGGGGTCGGCAATTGAACCGGTGCCTAGAGAAGGTGGCGCGGGGTAAACTGGG
AAAGTGATGTCGTGTACTGGCTCCGCCTTTTTCCCGAGGGTGGGGGAGAACCGTA
TATAAGTGCAGTAGTCGCCGTGAACGTTCTTTTTCGCAACGGGTTGCCGCCAGA
ACACA*GCGGCC*
```

6. (SEQ ID NO: 6) Forward Primer used to amplify COL3A1 where bold italicized underlined region represents the Kozac sequence
ATGTTAGCGGCCGC*GCCACC*ATGATGAGCTTTGTGCAAAAGGGGAGC 7. (SEQ ID NO: 7) Reverse Primer used to amplify COL3A1, where bold italicized underlined region represents a stop codon
CTTACGGCTAGC*TTA*TTATAAAAGCAAACAGGGCCAACGTCCAC 8. (SEQ ID NO: 8)
IFNG
*Homo sapiens* interferon gamma (IFNG), mRNA.
ORIGIN
```
    1 cacattgttc tgatcatctg aagatcagct attagaagag aaagatcagt taagtcctttt
   61 ggacctgatc agcttgatac aagaactact gatttcaact tctttggctt aattctctcg
  121 gaaacgatga atatacaag ttatatcttg gcttttcagc tctgcatcgt tttgggttct
  181 cttggctgtt actgccagga cccatatgta aaagaagcag aaaaccttaa gaaatatttt
  241 aatgcaggtc attcagatgt agcggataat ggaactcttt tcttaggcat tttgaagaat
  301 tggaaagagg agagtgacag aaaaataatg cagagccaaa ttgtctcctt ttacttcaaa
  361 cttttttaaaa actttaaaga tgaccagagc atccaeaaga gtgtggagac catcaaggaa
```

-continued

```
   421 gacatgaatg tcaagttttt caatagcaac aaaaagaaac gagatgactt cgaaaagctg
   481 actaattatt cggtaactga cttgcatgtc caacgcaaag caatacatga actcatccaa
   541 gtgatggctg aactgtcgcc agcagctaaa acagggaagc gaaaaaggag tcagatgctg
   601 tttcgaggtc gaagagcatc ccagtaatgg ttgtcctgcc tgcaatattt gaattttaaa
   661 tctaaatcta tttattaata tttaacatte tttatatggg gaatatattt ttagactcat
   721 caatcaaata agtatttatc atagcaactt tgtgtaatg aaaatgaata tctattaata
   781 tatgtattat ttataattcc tatatcctgt gactgtctca cttaatcctt tgttttctga
   841 ctaattactg aaggctatgt gattacaagg ctttatctca ggggccaact aggcagccaa
   901 cctaagcaag atcccatggg ttgtgtgttt atttcacttg atgatacaat gaacacttat
   961 aagtgaagtg atactatcca gttactgccg gtttgaaaat atgcctgcaa tctgagccag
  1021 tgctttaatg gcatgtcaga cagaacttga atgtgtcagg tgaccctgat gaaaacatag
  1081 catctcagga gatttcatgc ctggtgcttc caaatattgt tgacaactgt gactgtaccc
  1141 aaatggaaag taactcattt gttaaaatta tcaatatcta atatatatga ataaagtgta
  1201 agttcacaac aaaaaaaaaa aaaaaaaaaa aaaaaaaaaa
//

9. (SEQ ID NO: 9)
Human interferon-alpha mRNA, complete cds.
ORIGIN
     1 tgagcctaaa ccttaggctc acccatttca accagtctag cagcatctgc aacatctaca
    61 atggccttga cctttgcttt actggtggcc ctcctggtgc tcagctgcaa gtcaagctgc
   121 tctgtgggct gtgatctgcc tcaaacccac agcctgggta gcaggaggac cttgatgctc
   181 ctggcacaga tgaggaaaat ctctcttttc tcctgcttga aggacagaca tgactttgga
   242 tttccccagg aggagtttgg caaccagttc caaaaggctg aaaccatccc tgtcctccat
   301 gagatgatcc agcagatctt caatctcttc agcacaaagg actcatctgc tgcttgggat
   361 gagaccctcc tagacaaatt ctacactgaa ctctaccagc agctgaatga cctggaagcc
   421 tgtgtgatac agggggtggg ggtgcagag actcccctga tgaaggagga ctccattctg
   481 gctgtgagga aatacttcca aagaatcact ctctatctga agagaagaa atacagccct
   542 tgtgcctggg aggttgtcag agcagaaatc atgagatctt tttctttgtc aacaaacttg
   601 caagaaagtt taagaagtaa ggaatgaaaa ctggttcaac atggaaatga ttttcattaa
   661 ttcgtatgcc agctcacctt tttatgatct gccatttcaa agactcatgt ttctgctatg
   721 accatgacac gatttaaatc ttttttcacat gttttttagga gtattaatca acattgtatt
   781 cagctcttaa ggcactagtc ccttacagag gaccatgctg actgatccat tatctattta
   841 aatattttta aaatattatt tatttaacta tttataaaac aacttatttt tgttcatctt
   901 acgtcatgtg cacctttgca cagtggttaa tgtaataaaa tatgttcttt gtatttggta
   961 a
//

10. (SEQ ID NO: 10)
Homo sapiens interleukin 1 receptor antagonist (IL1RN), transcript
ORIGIN
     1 atttctttat aaaccacaac tctgggcccg caatggcagt ccactgcctt gctgcagtca
    61 cagaatggaa atctgcagag gcctccgcag tcacctaatc actctcctcc tcttcctgtt
   121 ccattcagag acgatctgcc gaccctctgg gagaaaatcc agcaagatgc aagccttcag
```

-continued

```
 181 aatctgggat gttaaccaga agaccttcta tctgaggaac aaccaactag ttgctggata
 241 cttgcaagga ccaaatgtca atttagaaga aaagatagat gtggtaccca ttgagcctca
 301 tgctctgttc ttgggaatcc atggagggaa gatgtgcctg tcctgtgtca agtctggtga
 361 tgagaccaga ctccagctgg aggcagttaa catcactgac ctgagcgaga acagaaagca
 421 ggacaagcgc ttcgccttca tccgctcaga cagtggcccc accaccagtt ttgagtctgc
 481 cgcctgcccc ggttggttcc tctgcacagc gatggaagct gaccagcccg tcagcctcac
 541 caatatgcct gacgaaggcg tcatggtcac caaattctac ttccaggagg acgagtagta
 601 ctgcccaggc ctgcctgttc ccattcttgc atggcaagga ctgcagggac tgccagtccc
 661 cctgccccag ggctcccggc tatggggca ctgaggacca gccattgagg ggtggaccct
 721 cagaaggcgt cacaacaacc tggtcacagg actctgcctc ctcttcaact gaccagcctc
 781 catgctgcct ccagaatggt ctttctaatg tgtgaatcag agcacagcag ccctgcaca
 841 aagccttcc atgtcgcctc tgcattcagg atcaaacccc gaccacctgc caacctgct
 901 ctcctcttgc cactgcctct tcctccctca ttccaccttc ccatgccctg gatccatcag
 961 gccacttgat gaccccaac caagtggctc ccacaccctg ttttacaaaa aagaaaagac
1021 cagtccatga gggaggtttt taagggtttg tggaaaatga aaattaggat ttcatgattt
1081 ttttttttca gtccccgtga aggagagccc ttcatttgga gattatgttc tttcggggag
1141 aggctgagga cttaaaatat tcctgcatttt gtgaaatgat ggtgaaagta agtggtagct
1201 tttcccttct ttttcttctt tttttgtgat gtcccaactt gtaaaaatta aaagttatgg
1261 tactatgtta gccccataat ttttttttc cttttaaaac acttccataa tctggactcc
1321 tctgtccagg cactgctgcc cagcctccaa gctccatctc cactccagat tttttacagc
1381 tgcctgcagt actttacctc ctatcagaag tttctcagct cccaaggctc tgagcaaatg
1441 tggctcctgg gggttctttc ttcctctgct gaaggaataa attgctcctt gacattgtag
1501 agcttctggc acttggagac ttgtatgaaa gatggctgtg cctctgcctg tctcccccac
1561 cgggctggga gctctgcaga gcaggaaaca tgactcgtat atgtctcagg tccctgcagg
1621 gccaagcacc tagcctcgct cttggcaggt actcagcgaa tgaatgctgt atatgttggg
1681 tgcaaagttc cctacttcct gtgacttcag ctctgtttta caataaaatc ttgaaaatgc
1741 ctaaaaaaaa aaaaaaaaa aaaaaaaaa aaaaaaaaa aaaa
//

11. (SEQ ID NO: 11)
Homo sapiens interleukin-2 (IL-2) mRNA, complete cds.
ORIGIN
    1 atcactctct ttaatcacta ctcacagtaa cctcaaotcc tgccacaatg tacaggatgc
   61 aactcctgtc ttgcattgca ctaagtcttg cacttgtcac aaacagtgca cctacttcaa
  121 gttctacaaa gaaaacacag ctacaactgg agcatttact gctggattta cagatgattt
  181 tgaatggaat taataattac aagaatccca aactcaccag gatgctcaca tttaagttt
  241 acatgcccaa gaaggccaca gaactgaaac atcttcagtg tctagaagaa gaactcaaac
  301 ctctggagga agtgctaaat ttagctcaaa gcaaaaaact tcacttaaga cccagggact
  361 taatcagcaa tatcaacgta atagttctgg aactaaaggg atctgaaaca acattcatgt
  421 gtgaatatgc tgatgagaca gcaaccattg tagaatttct gaacagatgg attacctttt
  481 gtcaaagcat catctcaaca ctaacttgat aattaagtgc ttcccactta aaacatatca
  541 ggccttctat ttatttaaat atttaaattt tatatttatt gttgaatgta tggtttgcta
```

-continued

```
   601 cctattgtaa ctattattct taatcttaaa actataaata tggatctttt atgattcttt 661 ttgtaagccc taggggctct aaaatggttt cacttattta tcccaaaata tttattatta 721 tgttgaatgt taaatatagt atctatgtag attggttagt ataactattt aataaatttg 781 ataaatataa aaaaaaaaaa caaaaaaaaa aa
//
```

12. (SEQ ID NO: 12)
Homo sapiens erythropoietin mRNA, complete cds.
ORIGIN

```
     1 atggggggtgc acgaatgtcc tgcctggctg tggcttctcc tgtccctgct gtcgctccct 61 ctgggcctcc cagtcctggg cgccccacca cgcctcatct gtgacagccg agtcctggag 121 aggtacctct tggaggccaa ggaggccgag aatatcacga cgggctgtgc tgaacactgc 181 agcttgaatg agaatatcac tgtcccagac accaaagtta atttctatgc ctggaagagg 241 atggaggtcg ggcagcaggc cgtagaagtc tggcagggcc tggccctgct gtcggaagct 301 gtcctgcggg gccaggccct gttggtcaac tcttcccagc cgtgggagcc cctgcagctg 361 catgtggata aagccgtcag tggccttcgc agcctcacca ctctgcttcg gctctggga 421 gcccagaagg aagccatctc ccctccagat gcggcctcag ctgctccact ccgaacaatc 481 actgctgaca cttccgcaa actcttccga gtctactcca atttcctccg gggaaagctg 541 aagctgtaca caggggaggc ctgcaggaca ggggacagat ga
//
```

13. (SEQ ID NO: 13)
Homo sapiens coagulation factor VIII (F8), transcript variant 2,
ORIGIN

```
     1 gcgtccccct cggcgggctg ccgccgtgcc cgcgccggct ccccagcccg agcctgcccc 61 ttgccctgat gaggtgcaaa gagcgggatc ggaggcgggg cctggccggg ctgtgagcgg 121 cgtatgcaaa tcgagggtct cggggatgcg gatccaagac cctgggaagg tcttctttgg 181 caatgtggat tcatctggga taaaacacaa tattttttaac cctccaatta ttgctcgata 241 catccgtttg cacccaactc attatagcat tcgcagcact cttcgcatgg agttgatggg 301 ctgtgattta aatagttgca gcatgccatt gggaatggag agtaaagcaa tatcagatgc 361 acagattact gcttcatcct actttaccaa tatgtttgcc acctggtctc cttcaaaagc 421 tcgacttcac ctccaaggga ggagtaatgc ctggagacct caggtgaata tccaaaagga 481 gtggctgcaa gtggacttcc agaagacaat gaaagtcaca ggagtaacta ctcagggagt 541 aaaatctctg cttaccagca tgtatgtgaa ggagttcctc atctccagca gtcaagatgg 601 ccatcagtgg actctctttt ttcagaatgg caaagtaaag gttttttcagg gaaatcaaga 661 ctccttcaca cctgtggtga actctctaga cccaccgtta ctgactcgct accttcgaat 721 tcaccccag agttgggtgc accagattgc cctgaggatg gaggttctgg gctgcgaggc 781 acaggacctc tactgagggt ggccactgca gcacctgcca ctgccgtcac ctctccctcc 841 tcagctccag ggcagtgtcc ctccctggct tgccttctac ctttgtgcta aatcctagca 901 gacactgcct tgaagcctcc tgaattaact atcatcagtc ctgcatttct ttggtggggg 961 gccaggaggg tgcatccaat ttaacttaac tcttacctat tttctgcagc tgctcccaga 1021 ttactccttc cttccaatat aactaggcaa aaagaagtga ggagaaacct gcatgaaagc 1081 attcttccct gaaaagttag gcctctcaga gtcaccactt cctctgttgt agaaaaacta 1141 tgtgatgaaa ctttgaaaaa gatatttatg atgttaacat ttcaggttaa gcctcatacg 1201 tttaaaataa aactctcagt tgtttattat cctgatcaag catggaacaa agcatgtttc
```

-continued

```
1261 aggatcagat caatacaatc ttggagtcaa aaggcaaatc atttggacaa tctgcaaaat
1321 ggagagaata caataactac tacagtaaag tctgtttctg cttccttaca catagatata
1381 attatgttat ttagtcatta tgaggggcac attcttatct ccaaaactag cattcttaaa
1441 ctgagaatta tagatggggt tcaagaatcc ctaagtcccc tgaaattata taaggcattc
1501 tgtataaatg caaatgtgca tttttctgac gagtgtccat agatataaag ccatttggtc
1561 ttaattctga ccaataaaaa aataagtcag gaggatgcaa ttgttgaaag ctttgaaata
1621 aaataacaat gtcttcttga aatttgtgat ggccaagaaa gaaaatgatg atgacattag
1681 gcttctaaag gacatacatt taatatttct gtggaaatat gaggaaaatc catggttatc
1741 tgagatagga gatacadact ttgtaattct aataatgcac tcagtttact ctctccctct
1801 actaatttcc tgctgaaaat aacacaacaa aaatgtaaca ggggaaatta tataccgtga
1861 ctgaaaacta gagtcctact tacatagttg aaatatcaag gaggtcagaa gaaaattgga
1921 ctggtgaaaa cagaaaaaac actccagtct gccatatcac cacacaatag gatccccctt
1981 cttgccctcc accccataa gattgtgaag ggtttactgc tccttccatc tgcctgaccc
2041 cttcactatg actacacaga atctcctgat agtaaagggg gctggaggca aggataagtt
2101 atagagcagt tggaggaagc atccaaagat tgcaacccag ggcaaatgga aaacaggaga
2161 tcctaatatg aaagaaaaat ggatcccaat ctgagaaaag gcaaagaat ggctactttt
2221 ttctatgctg gagtattttc taataatcct gcttgaccct tatctgacct ctttggaaac
2281 tataacatag ctgtcacagt atagtcacaa tccacaaatg atgcaggtgc aaatggttta
2341 tagccctgtg aagttcttaa agtttagagg ctaacttaca gaaatgaata agttgttttg
2401 ttttatagcc cggtagagga gttaacccca aaggtgatat ggttttattt cctgttatgt
2461 ttaacttgat aatcttattt tggcattctt ttcccattga ctatatacat ctctatttct
2321 caaatgttca tggaactagc tcttttattt tcctgctggt ttcttcagta atgagttaaa
2581 taaaacattg acacatacaa acaaaaaaaa aaaaaaa
//
```

14. (SEQ ID NO: 14)
*H. sapiens* factor IX mRNA.
ORIGIN

```
   1 tttgctagca gattgtgaac atgatcatgg cagaatcacc aggcctcatc accatctgcc
  61 ttttaggata tctactcagt gctgaatgta cagtttttct tgatcatgaa aacgccaaca
 121 aaattctgaa tcggccaaag aggtataatt caggtaaatt ggaagagttt gttcaaggga
 181 accttgagag agaatgtatg gaagaaaagt gtagttttga agaagcacga gaagttttg
 241 aaaacactga agaacaact gaattttgga agcagtatgt tgatggagat cagtgtgagt
 301 ccaatccatg tttaaatggc ggcagttgca aggatgacat taattcctat gaatgttggt
 361 gtcccttggg atttgaagga aagaactgtg aattagatgt aacatgtaac attaagaatg
 421 gcacatgcga gcagttttgt aaaaatagtg ctgataacaa ggtggtttgc tcctgtactg
 481 agggatatcg acttgcagaa aaccagaagt cctgtgaacc agcagtgcca tttccatgtg
 541 gaagagtttc tgtttcacaa acttctaagc tcacccgtgc tgaggctgtt tttcctgatg
 601 tggactatgt aaattctact gaagctgaaa ccattttgga taacatcact caaagcaccc
 661 aatcatttaa tgacttcact cgggttgttg gtggagaaga tgccaaacca ggtcaattcc
 721 cttggcaggt tgttttgaat ggtaaagttg atgcattctg tggaggctct atcgttaatg
 781 aaaaatggat tgtaactgct gcccactgtg ttgaaactgg tgttaaaatt acagttgtcg
```

-continued

```
 841 caggtgaaca taatattgag gagacagaac atacagagca aaagcgaaat gtgattcgaa
 901 ttattcctca ccacaactac aatgcagcta ttaataagta caaccatgac attgcccttc
 961 tggaactgga cgaacccta gtgctaaaca gctacgttac acctatttgc attgctgaca
1021 aggaatacac gaacatcttc ctcaaatttg gatctggcta tgtaagtggc tggggaagag
1081 tcttccacaa agggagatca gctttagttc ttcagtacct tagagttcca cttgttgacc
1141 gagccacatg tcttcgatct acaaagttca ccatctataa caacatgttc tgtgctggct
1201 tgcatgaagg agctagagat tcatgtcaag gagatagtgg gggacccat gttactgaag
1261 tggaagggac cagtttctta actggaatta ttagctgggg tgaagagtgt gcaatgaaag
1321 gcaaatatgg aatatatacc aaggtatccc ggtatgtcaa ctggattaag gaaaaaacaa
1381 agctcactta atgaaagatg gatttccaag gttaattcat tggaattgaa aattaacagg
1441 gcctctcact aactaatcac tttcccatct tttgttagat ttgaatatat acattctatg
1501 atcattgctt tttctcttta caggggagaa tttcatattt tacctgagca aattgattag
1561 aaaatggaac cactagagga atataatgtg ttaggaaatt acagtcattt ctaagggccc
1621 agcccttgac aaaattgtga agttaaattc tccactctgt ccatcagata ctatggttct
1681 ccactatggc aactaactca ctcaatttc cctccttagc agcattccat cttcccgatc
1741 ttctttgctt ctccaaccaa aacatcaatg tttattagtt ctgtatacag tacaggatct
1801 ttggtctact ctatcacaag gccagtacca cactcatgaa gaaagaacac aggagtagct
1861 gagaggctaa aactcatcaa aaacactact ccttttcctc taccctattc ctcaatcttt
1921 tacctttcc aaatcccaat ccccaaatca gttttttctct ttcttactcc ctctctccct
1981 tttaccctcc atggtcgtta aaggagagat ggggagcatc attctgttat acttctgtac
2041 acagttatac atgtctatca aacccagact tgcttccata gtggggactt gcttttcaga
2101 acatagggat gaagtaaggt gcctgaaaag tttgggggaa aagtttcttt cagagagtta
2161 agttatttta tatatataat atatatataa aatatataat atacaatata aatatatagt
2221 gtgtgtgtgt atgcgtgtgt gtagacacac acgcatacac acatataatg gaagcaataa
2281 gccattctaa gagcttgtat ggttatggag gtctgactag gcatgatttg acgaaggcaa
2341 gattggcata tcattgtaac taaaaaagct gacattgacc cagacatatt gtactctttc
2401 taaaaataat aataataatg ctaacagaaa gaagacaacc gttcgtttgc aatctacagc
2461 tagtagagac tttgaggaag aattcaacag tgtgtcttca gcagtgttca gagccaagca
2321 agaagttgaa gttgcctaga ccagaggaca taagtatcat gtctcctta actagcatac
2581 cccgaagtgg agaagggtgc agcaggctca aaggcataag tcattccaat cagccaacta
2641 agttgtcctt ttctggtttc gtgttcacca tggaacattt tgattatagt taatccttct
2701 atcttgaatc ttctagagag ttgctgacca actgacgtat gtttcccttt gtgaattaat
2761 aaactggtgt tctggttcaa a
//
```

15. (SEQ ID NO: 15)
Homo sapiens growth hormone 1 (GH1), transcript variant 1, mRNA.
ORIGIN

```
   1 aagagaccag ctcaaggatc ccaaggccca actccccgaa ccactcaggg tcctgtggac
  61 agctcaccta gctgcaatgg ctacaggctc ccggacgtcc ctgctcctgg cttttggcct
 121 gctctgcctg ccctggcttc aagagggcag tgccttccca accattccct tatccaggct
 181 ttttgacaac gctatgctcc gcgcccatcg tctgcaccag ctggcctttg acacctacca
```

```
241 ggagtttgaa gaagcctata tcccaaagga acagaagtat tcattcctgc agaaccccca 301 gacctccctc tgtttctcag agtctattcc gacaccctcc aacaggagg aaacacaaca 361 gaaatccaac ctagagctgc tccgcatctc cctgctgctc atccagtcgt ggctggagcc 421 cgtgcagttc ctcaggagtg tgttcgccaa cagcctggtg tacggcgcct ctgacagcaa 481 cgtctatgac ctcctaaagg acctagagga aggcatccaa acgctgatgg ggaggctgga 541 agatggcagc ccccggactg gcagatcttc aagcagacc tacagcaagt tcgacacaaa 601 ctcacacaac gatgacgcac tactcaagaa ctacgggctg ctctactgct tcaggaagga 661 catggacaag gtcgagacat tcctgcgcat cgtgcagtgc cgctctgtgg agggcagctg 721 tggcttctag ctgcccgggt ggcatccctg tgaccctcc ccagtgcctc tcctggccct 781 ggaagttgcc actccagtgc ccaccagcct tgtcctaata aaattaagtt gcatcatttt 841 gtctgaaaaa aaaaaaaaaa
//
```

16. (SEQ ID NO: 16)
VRC01-human broadly neutralizing HIV antibody
ACGAACAGGCGGCCGCCATGGCGACGGGTTCAAGAACTTCCCTACTTCTTGCATTTGGCCTGCTTTGTTTGCCGT
GGTTACAGGAGGGCTCGGCACAGGTGCAGCTGGTGCAGTCTGGAGGTCAGATGAAGAAGCCTGGCGAGTCGATGA
GAATTTCTTGTCGGGCTTCTGGATATGAATTTATTGATTGTACGCTAAATTGGATTCGTCTGGCCCCCGGAAAAA
GGCCTGAGTGGATGGGATGGCTGAAGCCTCGGGGGGGGCCGTCAACTACGCACGTCCACTTCAGGGCAGAGTGA
CCATGACTGAGACGTTTATTCCGACACAGCCTTTTTGGAGCTGCGCTCGTTGACAGTAGACGACACGGCCGTCT
ACTTTTGTACTAGGGGAAAAAACTGTGATTACAATTGGGACTTCGAACACTGGGGCCGGGGCACCCCGGTCATCG
TCTCATCACCGAGCACCAAGGGCCCATCGGTCTTCCCCCTGGCACCCTCCTCCAAGAGCACCTCTGGGGGCACAG
CGGCCCTGGGCTGCCTGGTCAAGGACTACTTCCCCGAACCGGTGACGGTGTCGTGGAACTCAGGCGCCCTGACCA
GCGGCGTGCACACCTTCCCGGCTGTCCTACAGTCCTCAGGACTCTACTCCCTCAGCAGCGTGGTGACCGTGCCCT
CCAGCAGCTTGGGCACCCAGACCTACATCTGCAACGTGAATCACAAGCCCAGCAACACCAAGGTGGACAAGAAAG
TTGAGCCCAAATCTTGTGACAAAACTCACACATGCCCACCGTGCCCAGCACCTGAACTCCTGGGGGGACCGTCAG
TCTTCCTCTTCCCCCCAAAACCCAAGGACACCCTCATGATCTCCCGGACCCCTGAGGTCACATGCGTGGTGGTGG
ACGTGAGCCACGAAGACCCTGAGGTCAAGTTCAACTGGTATGTTGACGGCGTGGAGGTGCATAATGCCAAGACAA
AGCCGCGGGAGGAGCAGTACAACAGCACGTACCGTGTGGTCAGCGTCCTCACCGTCCTGCACCAGGACTGGCTGA
ATGGCAAGGAGTACAAGTGCAAGGTCTCCAACAAAGCCCTCCCAGCCCCCATCGAGAAAACCATCTCCAAAGCCA
AAGGGCAGCCCCGAGAACCACAGGTGTACACCCTGCCCCCATCCCGGGATGAGCTGACCAAGAATCAACTCAGCC
TGACCTGCCTGGTCAAAGGCTTCTATCCCAGCGACATCGCCGTGGAGTGGGAGAGCAATGGGCAGCCGGAGAACA
ACTACAAGACCACGCCTCCCGTGCTGGACTCCGACGGCTCCTTCTTCCTCTACTCAAAACTCACCGTGGACAAGA
GCAGGTGGCAGCAGGGGAACGTCTTCTCATGCTCCGTGATGCATGAGGCTCTGCACAACCACTACACGCAGAAGA
GCCTCTCCCTGTCTCCGGGTCGAAAAAGAAGATCAGGTTCGGGTGCTCTACTCGGGCCGCTGGCATCCCAGACAGGTTCA
TGCTGAAACTTGCAGGTGATGTAGAGTCAAATCCAGGTCCAATGGCAACAGGGAGCCGAACCTCTCTGCTCCTTG
CTTTCGGGCTCCTTTGCCTACCGTGGCTCCAAGAGGGCTCGGCAGAATTGTGTTGACACAGTCTCCAGGCACCC
TGTCTTTGTCTCCAGGGGAAACAGCCATCATCTCTTGTCGGACCAGTCAGTATGGTTCCTTAGCCTGGTATCAAC
AGAGGCCCGGCCAGGCCCCCAGGCTCGTCATCTATTCGGGCTCTACTCGGGCCGCTGGCATCCCAGACAGGTTCA
GCGGCAGTCGGTGGGGGCCAGACTACAATCTCACCATCAGCAACCTGGAGTCGGGAGATTTTGGTGTTTATTATT
GCCAGCAGTATGAATTTTTTGGCCAGGGGACCAAGGTCCAGGTCGACATTAAACGTACGGTGGCCGCTCCCAGCG
TGTTCATCTTCCCTCCCTCTGATGAACAGCTGAAAAGCGGAACAGCCAGCGTGGTGTGTCTGCTGAACAACTTCT
ACCCCAGAGAAGCCAAAGTGCAGTGGAAGGTGGACAACGCCCTGCAGAGCGGAAACAGCCAGGAAAGCGTGACAG
AGCAGGATTCCAAGGATTCCACATACAGCCTGAGCAGCACACTGACACTGTCCAAGGCCGACTACGAGAAGCACA
AGGTGTACGCCTGCGAAGTGACACACCAGGGACTGTCCTCCCCTGTGACAAAGAGCTTCAACAGAGCAGAATGCT
AAAGG 17. (SEQ ID NO: 17)
shEF1a-WPRE3-SV40LpA backbone
CTAGCAATCAACCTCTGGATTACAAAATTTGTGAAAGATTGACTGGTATTCTTAACTATGTTGCTCCTTTTACGC
TATGTGGATACGCTGCTTTAATGCCTTTGTATCATGCTATTGCTTCCCGTATGGCTTTCATTTTCTCCTCCTTGT
ATAAATCCTGGTTAGTTCTTGCCACGGCGGAACTCATCGCCGCCTGCCTTGCCCGCTGCTGGACAGGGGCTCGGC
TGTTGGGCACTGACAATTCCGTGGTGTTTATTTGTGAAATTTGTGATGCTATTGCTTTATTTGTAACCATTCTAG
CTTTATTTGTGAAATTTGTGATGCTATTGCTTTATTTGTAACCATTATAAGCTGCAATAAACAAGTTAACAACAA
CAATTGCATTCATTTTATGTTTCAGGTTCAGGGGGAGATGTGGGAGGTTTTTTAAAGCGGGGGATCCAAATTCCC
GATAAGGATCTTCCTAGAGCATGGCTACGTAGATAAGTAGCATGGCGGGTTAATCATTAACTACAAGGAACCCCT
AGTGATGGAGTTGGCCACTCCCTCTCTGCGCGCTCGCTCGCTCACTGAGGCCGGGCGACCAAAGGTCGCCCGACG
CCCGGGCTTTGCCCGGGCGGCCTCAGTGAGCGAGCGAGCGCGCAGCCTTAATTAACCTAATTCACTGGCCGTCGT
TTTACAACGTCGTGACTGGGAAAACCCTGGCGTTACCCAACTTAATCGCCTTGCAGCACATCCCCCTTTCGCCAG
CTGGCGTAATAGCGAAGAGGCCCGCACCGATCGCCCTTCCCAACAGTTGCGCAGCCTGAATGGCGAATGGGACGC
GCCCTGTAGCGGCGCATTAAGCGCGGCGGGTGTGGTGGTTACGCGCAGCGTGACCGCTACACTTGCCAGCGCCCT
AGCGCCCGCTCCTTTCGCTTTCTTCCCTTCCTTTCTCGCCACGTTCGCCGGCTTTCCCCGTCAAGCTCTAAATCG
GGGGCTCCCTTTAGGGTTCCGATTTAGTGCTTTACGGCACCTCGACCCCAAAAAACTTGATTAGGGTGATGGTTC
ACGTAGTGGGCCATCGCCCTGATAGACGGTTTTTCGCCCTTTGACGTTGGAGTCCACGTTCTTTAATAGTGGACT
CTTGTTCCAAACTGGAACAACACTCAACGCTATCTCGGTCTATTCTTTTGATTTATAAGGGATTTTGCCGATTTC
GGCCTATTGGTTAAAAAATGAGCTGATTTAACAAAAATTTAACGCGAATTTTAACAAAATATTAACGTTTATAAT
TTCAGGTGGCATCTTTCGGGGAAATGTGCGCGGAACCCCTATTTGTTTATTTTTCTAAATACATTCAAATATGTA

```
TCCGCTCATGAGACAATAACCCTGATAAATGCTTCAATAATATTGAAAAAGGAAGAGTATGAGTATTCAACATTT
CCGTGTCGCCCTTATTCCCTTTTTTGCGGCATTTTGCCTTCCTGTTTTTGCTCACCCAGAAACGCTGGTGAAAGT
AAAAGATGCTGAAGATCACTTGGGTCCACGAGTGGGTTACATCGAACTGGATCTCAATAGTGGTAAGATCCTTGA
GAGTTTTCGCCCCGAAGAACGTTTTCCAATGATGAGCACTTTTAAAGTTCTGCTATGTGGCGCGGTATTATCCCG
TATTGACGCCGGGCAAGAGCAACTCGGTCGCCGCCATACACTATTCTCAGAATGACTTGGTTGAGTACTCACCAGT
CACAGAAAAGCATCTTACGGATGGCATGACAGTAAGAGAATTATGCAGTGCTGCCATAACCATGAGTGATAACAC
TGCGGCCAACTTACTTCTGACAACGATCGGAGGACCGAAGGAGCTAACCGCTTTTTTGCACAACATGGGGGATCA
TGTAACTCGCCTTGATCGTTGGGAACCGGAGCTGAATGAAGCCATACCAAACGACGAGCGTGACACCACGATGCC
TGTAGTAATGGTAACAACGTTGCGCAAACTATTAACTGGCGAACTACTTACTCTAGCTTCCCGGCAACAATTAAT
AGACTGGATGGAGGCGGATAAAGTTGCAGGACCCACTTCTGCGCTCGGCCCTTCCGGCTGGCTGGTTTATTGCTGA
TAAATCTGGAGCCGGTGAGCGTGGGTCTCGCGGTATCATTGCAGCACTGGGGCCAGATGGTAAGCCCTCCCGTAT
CGTAGTTATCTACACGACGGGGAGTCAGGCAACTATGGATGAACGAAATAGACAGATCGCTGAGATAGGTGCCTC
ACTGATTAAGCATTGGTAACTGTCAGACCAAGTTTACTCATATATACTTTAGATTGATTTAAAACTTCATTTTTA
ATTTAAAAGGATCTAGGTGAAGATCCTTTTTGATAATCTCATGACCAAAATCCCTTAACGTGAGTTTTCGTTCCA
CTGAGCGTCAGACCCCGTAGAAAAGATCAAAGGATCTTCTTGAGATCCTTTTTTTCTGCGCGTAATCTGCTGCTT
GCAAACAAAAAAACCACCGCTACCAGCGGTGGTTTGTTTGCCGGATCAAGAGCTACCAACTCTTTTTCCGAAGGT
AACTGGCTTCAGCAGAGCGCAGATACCAAATACTGTCCTTCTAGTGTAGCCGTAGTTAGGCCACCACTTCAAGAA
CTCTGTAGCACCGCCTACATACCTCGCTCTGCTAATCCTGTTACCAGTGGCTGCTGCCAGTGGCGATAAGTCGTG
TCTTACCGGGTTGGACTCAAGACGATAGTTACCGGATAAGGCGCAGCGGTCGGGCTGAACGGGGGTTCGTGCAC
ACAGCCCAGCTTGGAGCGAACGACCTACACCCAACTGAGATACCTACAGCGTGAGCTATGAGAAAGCGCCACGCT
TCCCGAAGGGAGAAAGGCGGACAGGTATCCGGTAAGCGGCAGGGTCGGAACAGGAGAGCGCACGAGGGAGCTTCC
AGGGGGAAACGCCTGGTATCTTTATAGTCCTGTCGGGTTTCGCCACCTCTGACTTGAGCGTCGATTTTTGTGATG
CTCGTCAGGGGGCGGAGCCTATGGAAAAACGCCAGCAACGCGGCCTTTTTACGGTTCCTGGCCTTTTGCTGGCC
TTTTGCTCACATGTTCTTTCCTGCGTTATCCCCTGATTCTGTGGATAACCGTATTACCGCCTTTGAGTGAGCTGA
TACCGCTCGCCGCAGCCGAACGACCGAGCGCAGCGAGTCAGTGAGCGAGGAAGCGGAAGAGCGCCCAATACGCAA
ACCGCCTCTCCCCGCGCGTTGGCCGATTCATTAATGCAGCTGGCACGACAGGTTTCCCGACTCCAAAGCGGGCAG
TGAGCGCAACGCAATTAATGTGAGTTAGCTCACTCATTAGGCACCCCAGGCTTTACACTTTATGCTTCCGGCTCG
TATGTTGTGTGGAATTGTGAGCGGATAACAATTTCACACAGGAAACAGCTATGACCATGATTACGCCAGATTTAA
TTAAGGCCTTAATTAGGCTGCGCGCTCGCTCGCTCACTGAGGCCGCCCGGGCAAAGCCCGGGCGTCGGGCGACCT
TTGGTCGCCCGGCCTCAGTGAGCGAGCGAGCGCGCAGAGAGGGAGTGGCCAACTCCATCACTAGGGGTTCCTTGT
AGTTAATGATTAACCCGCCATGCTACTTATCTACGTAGCCATGCTCTAGGAAGATCGGAATTCCTAGGCTCCGGT
GCCCGTCAGTGGGCAGAGCGCACATCGCCCACAGTCCCCGAGAAGTTGGGGGAGGGGTCGGCAATTGAACCGGT
GCCTAGAGAAGGTGGCGCGGGGTAAACTGGGAAAGTGATGTCGTGTACTGGCTCCGCCTTTTTCCCGAGGGTGGG
GGAGAACCGTATATAAGTGCAGTAGTCGCCGTGAACGTTCTTTTTCGCAACGGGTTTGCCGCCAGAACACAGCGG
CC
```

SEQUENCE LISTING (90 sequences)

SEQ ID NO: 1 - DNA, 4321 bp, Artificial Sequence
  Description of Artificial Sequence: Synthetic polynucleotide
cccacgcgtccggactagttctagatcgcgagcggcccggagttggggcgccttgccccgggccccccagcatgaagaccccggcggacacagggtttgccttcccagattgggcctacaaaccggagtcatcccctggctccaggcagatccagctgtggcactttatcctggagctgcttcggaaagaggagtaccagggcgtcatcgcttggcagggggactacggggagtttgtcatcaaggaccctggtgaacctggcgagcctggcggttcaggtccaatgggtccccgaggtccccctggccctcctggcaagaatggagatgatggggaagctggcaagcccggccgtcctggtgagcgtggacctcctggacctcagggtgctcgtggattgcctggaacagctggcctccctggaatgaagggacaccgaggcttcagtggtttggatggtgccaaaggagatgctggtcctgctggtcctaagggagagcccggcagtcctggtgaaaacggagctcctggccagatgggtccccgaggtctgcccggtgagagaggtcgccctggacctcctggcactgctggtgctcgcggtaacgatggtgctgttggtgctgctggaccccctggtcccaccggccccactggccctcctggcttccctggtgcagttggtgctaagggtgaagctggtccccaaggagctagaggctctgaaggtccccagggtgtgcgtggtgagcccggaccccctggccctgctggtgctgccggccctgctggaaaccctggtgctgatggacaacctggcgctaaaggtgccaatggtgctcctggtattgctggtgctcctggcttccctggtgcccgaggcccctctggaccccagggccccagcggccctccaggtcccaagggtaacagtggtgaacctggtgctcctggcaacaaaggagacactggtgccaaaggagaacccggtgctactggagttcaaggtcccccaggccctgccggagaagaaggaaaacgaggagcccgtggtgagcctggaccttccggactgcctggacctcctggcgagcgtggtggacctggtagccgtggtttccctggtgctgatggtgttgctggccccaagggtccttccggtgaacgtggtgctcccggacctgctggtcccaaaggttctcctggtgaagctggtcgccccggtgaagctggtctccctggtgccaagggtctcactggcagtcctggcagccctggtcctgatggcaaaaccggcccccctggtcccgctggtcaagatggtcgccctggacccgcaggtcctcctggagcccgtggccaggctggtgtgatgggattccctggacctaagggtaccgctggagaacctggaaaggctggagagcgaggccttcccggaccccctggcgctgttggtcctgctggcaaagatggagaagctggagctcagggagcccctggccctgctggtcctgctggtgagagaggtgaacaaggtcccgctggctcccctggattccagggtcttcctggtcctgccggtcctcctggtgaagcaggcaagcctggtgaacagggtgttcctggagaccttggtgcccctggaccctctggcgcaagaggcgagagaggtttccctggtgaacgtggtgtacaaggtcccccaggtcctgctggtccccgaggaaacaatggtgcccccggcaacgatggtgccaagggtgatactggtgcccccggagctcccggtagccagggtgcccccggtcttcagggaatgcctggtgaacgtggtgcagctggtcttccaggtcctaagggtgacagaggtgatgctggtcccaaaggtgctgatggttctcctggtaaagatggtgcccgtggtctgactggtcccattggtcctcctggccctgctggtgcccctggtgacaagggtgaagctggtcccagtggtcctcccggtcccaccggagcccgtggtgctcccggagaccgtggtgaggctggtccccctggtcctgctggctttgccggcccccctggtgctgatggccaacctggtgcgaaaggtgaacctggtgatactggtgttaaaggtgatgctggtcctcctggccctgctggtcctgctggaccccccggccccattggtaacgttggtgctcctggacccaaaggtcctcgtggtgctgctggtccccctggtgctactggcttccctggtgctgctggccgtgtcggtccccctggtccctctggaaatgctggaccccctggccctcccggtcccgttggcaaagaagggggcaaaggtccccgtggtgagactggccctgctggacgtcctggtgaagttggtcccccaggtccccccggtcctgctggtgagaaaggatctcctggtgctgatggacctgctggctctcctggtacccctggacctcagggtattgctggacaacgtggtgtggtcggtcttcccggtcagagaggagaaagaggcttccctggtcttcctggcccctctggtgaacctggcaaacaaggtccttctggatcaagtggtgaacgcggtccccctggccccatggggccccctggattggctggtccccctggtgaatctggacgtgagggatcccctggtgctgaaggctcccctggaagggatggtgctcccggggccaagggtgaccgtggtgagactggccctgctggcccccctggtgcccctggtgctcccggtgctcccggccctgttggtcccgctggcaagaatggcgatcgtggtgagactggtcctgctggtcctgctggtcccattggccctgctggtgcccgtggccctgctggaccccaaggcccccgtggtgacaagggtgagacaggcgaacaaggtgacagaggcataaagggtcatcgtggcttctctggtctccagggtcctcctggttctcctggttctcctggtgaacaaggcccctctggagcttcaggtcctgcaggcccccggggtccccctggctctgctggttctcctggcaaagacggactcaacggtctccctggccccattggtccccctggtcctcgaggtcgcactggtgacagcggccctgctggtccccccggccctcctggaccccctggccctcctggacctcccagtggcggttatgacttcagcttcctgcctcagccacctcaagagaagtctcaagatggtggccgctactaccgggccgatgatgctaacgtggttcgtgaccgtgaccttgaggtggacaccaccctcaagagcctgagtcagcagattgagaacatccgcagccccgaaggcagccgcaagaaccctgcccgcacatgccgcgacctcaagatgtgccactctgactggaagagcggagagtactggatcgaccctaaccaaggctgcaacctggacgccatcaaggtctactgcaacatggagacaggtcagacctgtgtgttccctactcagccgtctgtgcctcagaagaactggtacatcagcccgaaccccaaggaaaagaagcacgtctggtttggagagagcatgaccgatggattcccgttcgagtacggaagcgagggctccgaccccgccgatgtcgctatccagctgaccttcctgcgcctaatgtccaccgaggcctcccagaacatcacctatcactgcaagaacagcgtagcctacatggaccagcagactggcaacctcaagaaggccctgctcctccagggatccaacgagatcgagctcagaggcgaaggcaacagtcgcttcacctacagcacccttgtggacggctgcacgagtcacaccggaacttggggcaagacagtcatcgaatacaaaaccaccaagacctcccgcctgcccatcatcgatgtggctcccttggacattggtgccccagaccaggaattcggactagacattggccctgcctgcttcgtgtaaactccctccaccccaatctggttccctcccacccagcccacttttccccaaccctggaaacagacgaacaacccaaactcaatttcccccaaaagccaaaaatatgggagataatttcacatggactttggaaaacattttttttcctttgcattcacctttcaaacttagtttttacctttgaccaactgaacgtgaccaaaaaccaaaagtgcattcaaccttaccaaaaaagaaaaaaaaaaaagaataaataaataactttttaaaaaaggaaaaaaaaaaaaaaa

SEQ ID NO: 2 - DNA, 3902 bp, Homo sapiens
ccacgcgtccggacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcagggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataaaaaaaaaaaaaaaa

SEQ ID NO: 3 - DNA, 130 bp, Artificial Sequence
  Description of Artificial Sequence: Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcct

SEQ ID NO: 4 - DNA, 141 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcct

SEQ ID NO: 5 - DNA, 3902 bp, Artificial Sequence
  Description of Artificial Sequence: Synthetic polynucleotide
ctagcaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggtgtttatttgtgaaatttgtgatgctattgctttatttgtaaccattctagctttatttgtgaaatttgtgatgctattgctttatttgtaaccattataagctgcaataaacaagttaacaacaacaattgcattcattttatgtttcaggttcagggggagatgtgggaggttttttaaagcgggggatccaaattcccgataaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagccttaattaacctaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttataatttcaggtggcatctttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaatagtggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagtaatggtaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccagatttaattaaggccttaattaggctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcctaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagcggcc

SEQ ID NO: 6 - DNA, 47 bp, Artificial Sequence
  Description of Artificial Sequence: Synthetic primer
atgttagcggccgcgccaccatgatgagctttgtgcaaaaggggagc

SEQ ID NO: 7 - DNA, 45 bp, Artificial Sequence
  Description of Artificial Sequence: Synthetic primer
cttacggctagcttattataaaaagcaaacagggccaacgtccac

SEQ ID NO: 8 - DNA, 3740 bp, Homo sapiens
gggacggcggcggcgcagctcggaacccgccagggtccagggtccaggttccagcgcccggcggcccaggcaccccccgagcccagctccacacaccgttcctggatctcctctccccaggcggagcgtgcccctgcccagtccagtgaccttcgcctgttggagccctggttaatttttgcccagtctgcctgttgtggggctcctcccctttggggatataagcccggcctggggctgctccgttctctgcctggcctgaggctccctgagccgcctccccaccatcaccatggccaagggcttctatatttccaagtccctgggcatcctggggatcctcctgggcgtggcagccgtgtgcacaatcatcgcactgtcagtggtgtactcccaggagaagaacaagaacgccaacagctcccccgtggcctccaccaccccgtccgcctcagccaccaccaaccccgcctcggccaccaccttggaccaaagtaaagcgtggaatcgttaccgcctccccaacacgctgaaacccgattcctaccgggtgacgctgagaccgtacctcacccccaatgacaggggcctgtacgtttttaagggctccagcaccgtccgtttcacctgcaaggaggccactgacgtcatcatcatccacagcaagaagctcaactacaccctcagccaggggcacagggtggtcctgcgtggtgtgggaggctcccagccccccgacattgacaagactgagctggtggagcccaccgagtacctggtggtgcacctcaagggctccctggtgaaggacagccagtatgagatggacagcgagttcgagggggagttggcagatgacctggcgggcttctaccgcagcgagtacatggagggcaatgtcagaaaggtggtggccactacacagatgcaggctgcagatgcccggaagtccttcccatgcttcgatgagccggccatgaaggccgagttcaacatcacgcttatccaccccaaggacctgacagccctgtccaacatgcttcccaaaggtcccagcaccccacttccagaagaccccaactggaatgtcactgagttccacaccacgcccaagatgtccacgtacttgctggccttcattgtcagtgagttcgactacgtggagaagcaggcatccaatggtgtcttgatccggatctgggcccggcccagtgccattgcggcgggccacggcgattatgccctgaacgtgacgggccccatccttaacttctttgctggtcattatgacacaccctacccactcccaaaatcagaccagattggcctgccagacttcaacgccggcgccatggagaactggggactggtgacctaccgggagaactccctgctgttcgaccccctgtcctcctccagcagcaacaaggagcgggtggtcactgtgattgctcatgagctggcccaccagtggttcgggaacctggtgaccatagagtggtggaatgacctgtggctgaacgagggcttcgcctcctacgtggagtacctgggtgctgactatgcggagcccacctggaacttgaaagacctcatggtgctgaatgatgtgtaccgcgtgatggcagtggatgcactggcctcctcccacccgctgtccacacccgcctcggagatcaacacgccggcccagatcagtgagctgtttgacgccatctcctacagcaagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctgcagatgggcttcccggtcatcacggtggataccagcacggggaccctttcccaggagcacttcctccttgaccccgattccaatgttacccgcccctcagaattcaactacgtgtggattgtgcccatcacatccatcagagatggcagacagcagcaggactactggctgatagatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtggatggagaaccccaataataacccgatccaccccaacctgcggtccaccgtctactgcaacgctatcgcccagggcggggaggaggagtgggacttcgcctgggagcagttccgaaatgccacactggtcaatgaggctgacaagctccgggcagccctggcctgcagcaaagagttgtggatcctgaacaggtacctgagctacaccctgaacccggacttaatccggaagcaggacgccacctctaccatcatcagcattaccaacaacgtcattgggcaaggtctggtctgggactttgtccagagcaactggaagaagctttttaacgattatggtggtggctcgttctccttctccaacctcatccaggcagtgacacgacgattctccaccgagtatgagctgcagcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatagtccccagcccttgaagtcacccggcccccatgcaaggtgcccacatgtgtccatcccagcggctggtgcagggcctccattcctggagcccgaggcaccagtgtcctcccctcaaggacaaagtctccagcccacgttctctctgcctgtgagccagtctagttcctgatgacccaggctgcctgagcacctcccagcccctgcccctcatgccaaccccgccctaggcctggcatggcacctgtcgcccagtgccctggggctgatctcagggaagcccagctccagggccagatgagcagaagctctcgatggacaatgaacggccttgctgggggccgccctgtaccctctttcacctttccctaaagaccctaaatctgaggaatcaacagggcagcagatctgtatatttttttctaagagaaaatgtaaataaaggatttctagatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 9 - DNA, 2613 bp, Homo sapiens
aaccgtctcctggttggggggtgggggggaaagatggcggagctgatgctgctcagcgagattgctgacccgacgcgtttcttcaccgacaacctgcttagcccggaggactgggacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaaaaaaa

SEQ ID NO: 10 - DNA, 1021 bp, Homo sapiens
ccaacgctgcggagatccagaggccggcggcgcccggaaacacccgcggagcttgccccctccccacccgcagacatgtccgagtccaagagcggccccgagtatgcttcgtttttcgccgtcatgggcgcctcggccgccatggtcttcagcgccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtgacgggc

SEQ ID NO: 11 - DNA, 151326 bp, Homo sapiens
tacaaatgtactttgtttcatgtaattttatgagttggaagtattttcttaaattggaacactataagataatatctttaggaaatggatatgccacaataggaagtatagtggggcaagtcttgtttttctcaagggaaaagccaccagcctgctttcataggcattgataaaaccaggaagaaaataaagtcacaaccaaatagtatacactgtctctactgaattcttctaattccttcccaacagaagtctaaatcctgcttagcctaaacatatctatagccagcgatgggcaaattatatttgctgtcagcatgatagaataagaatcagaaaccccccagcagtggggtaagatcgtgcacttcatcccctcaaaatgctgtcaaccccattccctctccatgccctcaaacaactgcacagtcacttgttagtgaatttctcgttcagcgttttgtttttttctctccatacttaaagaccaaatcatttgtttgctctgaagaaaaagaaaaaacaaaacaaaacaaaaaaccacccaccaaatcatttgaaatcactacccgttaaaaaaaatcaccagtggaactaaacagttgagtggtttgggatgtgttcgccatttctgtgtttgacctacatggcctctagttctttggaccactgtaactgtgaaaccatggcttaatactgttaaagaccccaaggctcaactctgtagccagggtgtacctcaggctgcacaaatatcacaccagaatgtcacaatcattcattgctccagctactgagtgaacagggtgcaagacagcactggcttgggttgtatttttgcagccagttaactttgcatcaggtctacacagtccttgcagcctttgatttctccagttgtagagatttgaaatggggtgcccgggttcctctcgtttttccttcaacctacctagcatgcattttacacacattggaggagtcttatgcactgtttttctctgttgctgatggaggcaagaaggccttctaattagtctaacttaaacggacgggattcacctaacaaaagcaagaagaaaagcacaagaacaggtgtcttaatgcatttggataatttatttggggtgtgtgcgtgtgtgtgtgtgtcttggtggaggtgggggccgtgttctcaccaagccttttcataatcaagtttgctttgcaaactttatggccttacacccagcagaacagtccttgctaataaaaggaggatgccctgtcacagttctctgtaaattatcatgtgttgggaagttctgttgatgcttagtttgatcttccatggtggacacatctgttctgtatgtacaaggcattacatgtgtgttttagcggatgggaattgaagcctttccacagtccttgtgctctgagatggctgttgagctctgctcagctgtcgtagctgaattctttttttgtgctgaacactgggcagcctcaccatgttgtcaatgtgcttctggggcccctgtgactgctgccagatgccatgcacacaagcagagtgcctttgcaggtttgtgcaccccttggcgagctggaactgggagccctgtggggtgatctcgccttctcatggggggtcggggaggggagtgcctatttttaatcttgtctgtttgttgcaccatggaaatcactgtgatttgtatatatgccctaggaaatttttactgcagtctaatttatgtaataatgttgattccaggtttgtttaataaagctttgtatcttttaagaaaaaaaaaactgtagcatgtagaggaaagtgcactgggataatccaaggccaggctttgaggttccaccgctacattatgtgactcttagtctaaaccttttggtgtaatttctttggtctgattatttataagtagcagataataaatgaattttatactacaaacacaagtgacaagcttttgcctcttcttcctttttattaaagtaaaacatacataggtgtaacctcttaaataatttttcttgtcataaattacatatttgtcattttattgtagtgtttcctttgttttcttttgggttgcatatggattgttagtgatttgtatttctctcttatagttatttggaaaatatatctgctttaaatcattgcctttcttttttttgaaaccaagtctcactctgtcacccaggctggagtgcagtagcacaatctcagctcactgcagcctccacctcctgggttcaaacaattcagtctcagccacctgagtagctgggattacagacgtgcaccaccacacccagctaacttttgtatctttagtagagacagggtttcaccatgttgtccaggctggtctccaactcctgacctcaagagatctgcccgcctcagcctcccaaagtgctgggattataggtgtgagccaccatgcccagccaaatcattgcctttctatgcttttattttttagttttttggagacagggtctacctctgtcatccaggctggagtgcagtgacacaatcatggtggcccactgcagccttgaaactcctgcgtacaagtgatcctcccctatcagccccccgagtagctgagactataggtgtgtgccaccatgcccagccttttacatttgtttgtagagatagggtctcactatgttgcccagcttggtttcaaactcagcctcaagtgatcctcccacatcagcctcccaaagcactaggattacaggcatgagcctctgcacccaggcacttttctcctcttttcaaaaaatatgcttgaaaattcctttttttagtcatcaaagccaagactgaagtaaattatgcatgtaatgggcttcctgccccctccagctttctggccattgttaatttcacttgaatttataaaccaaattgctattcccaatgattttttacactatacatcttctccttaaattttattcttgacttttacactacatcttgttatcaccattatatttattatttagtctttactctatttcatgatgtgtctaatgaaaaaatcttaatttgtgttcctttctttggtaatgtttccaggaaaaatggctgggttatgtaagcatcccaacaatttcctaagaagaaagatatattttctgagactttgtatatcagagtatgtcttttggttgccattcttttggttaatggcaatatgatgtcttttataaacccatcccacattttttttttttttgagacggagttgctcttgttacccaggctggagtgcaatggcagaatcttggctcactgcaaactctgcctcccaaatctcagcctcccaggtagctgggattgtaggcatgcaccaccatacccagctaattttgtatttttagtagagatggggtttcaccatgttagtcaggctggtcttgaacccctgacctcaggtgatccacctgcctcggcctcccaaagtgctgggattataggcatgagccaccacgcctggtcctctttacttcttcatacccgatttgatcttcttccgtgtcaattcaattcattacatccaaaacaggttttactcatgagggaattagtgtgtcaaaaggctattaaaaagcactaacaaggctgggtgtggaggctcacatctgtaatcctagcactttgggaggccaaggtgggcagattgcttgagcccaggagttggagatcagcctgggcaacatggtgaaaccccatctctacaaaaaaatacaaaaattagtcgggtatagtggttcacgcctgtcgttagttactcaggaggctggggcgagaggatcacctgagctcagcaagttaaggctgcggtaagctgtgattgtgccactgcactctagcctgggtgagagtgagactctgtctccaaaaaaacaacaacaacaaaaaaagaggttgggcgcagtggctcacttctgtaatcccagcactttgtgaggccaaggcaggtggatcaccaggtcaagatattgagaccatcttggccaacatggtgaaatcctgtctctactaaaaatacaaaaattagctgggcgtggtgccgcgtggctatagtcccagctattcgggaggctgggggggagaatcgcttgaacccaggaggcagaggttgcagtgagccacagcaccccagcctggtgacagtgtgagacgccatcttaaaaaaaataataataaataaaataaaataaaatagaaaaaaaaagcactaaaaagcctgaagtcacacatcccaaagttagtgaatgagtggagtttaaacccagggctgtatggctatcatgcctgttttcccctactctgctacactgtctcctctgtaaatgttttgttttgtcttttggagacagggtctcactctgtcacccatgctgaagtgcagtggtgccagcacagctcactgcatgtaaatggttttcctagatttgtattttaatcaaatattcagagaaacaatgctccctgttctctctcgctggggatggtttcattgccttatcttatctattttctatttttccgtgtctgttaattcagcctcataatgggaaatggctgcagacctgggcttgctggctgagataatccatgggtgcttatggacttactccagaagggcttccccttcctatcaacagcctgtagacccttcgtgttttcaccttctgaagaggttgtgtaaggcgctgggttcggaatcacggaaggcccaggtgcaaacctcagcagtcccgggtaccagctgtgcagcgcaggtgagccgcttagcccctctcacccagtcacgagtgatggtgtctcgcgaggccggtgtaggacgagtgtggtccaggcgcagtacctgaaaagggcgcccagggagggagccggcggtcgttgggcgctctctcggcccgcacccgggcatccctcgacccgggctggaggggcagtgtcccgggatgcaccgctgcggggaccccccgcccggcctcgcggacccgcctcggcccaggacggaggaggaggcaggtgcggggcccggggcgggtgcggggacggcaggtggagggaagagggcatcgggccctgctcaccgcggtgtgtggggctgcccgaccgcgccccccgcaggtgccgcccagaccccggccgagggtcctcgtccccgcgcaggcccaggtcgaggccgagagagggcccgtgtccccgcgcagacctaggccgagagagggcccgtgaccccgcgcaggtcaaggccgagagagggcccgtgtccccgcggaggtcaaggccgagagagggcccgtgtccccgcgcaggtcaaggcccagagtccccgtgctcgcacagatggtgtcctggggcccagtcgcgctccccgctcgcggcagcccccgtgtactgggccttgcaaagtccgttaggagcgctccagggcgacagtgcccagcggttaacaagtttgtaattactttcgtgggtttctacgttgcaaattgagaagagggttgctgggttgggcccccctcctctggacgctaaccccacccaggtaaacagggatctggcccaggttcctgctgggtgccgaggtgggggattcagtggggagcactgaaatgtgctggaggcctggacgtgattccactgccaccaccccctttcccccggctacaaagcctcctgcggtgtgctttgtttttcccaggtagcagttattagccctgtatcatgactaaacgaacactaaagatacccttttacttattctcaaattcaaaacatgtatcaggggtccagaattatacatgctaggacctcaaaggtaagaaaggcacccacccacagccacgtgcggtggcacacgcctgtaatcccagcactttgagaggccaaggtgggcgaatcaccagaggtcaagagtttgaaactagcctggccaacatggtgaaaccccgtctctactcaaaatacaaaaataagccgagcgtggtggtgggcacctgtgatcccagctactggggaggctgaggcaggagaatcgcttgaacccaggaggcagaggtgacagtgagccgagatcgcgccattgcactccagcctgggcaacaagagcaaaacttctaataaaaaaaaaaaaaagaaagaaaggaaggagggagaggaagggagggaaggaaggaaggaaggaagccttctcttgtggtcatagttcagaggactgaatcactctgatatttgagcttaccctcaatttcaaaactctcattagaaaatgtttttaaatcacctgaaatgagaacaaaatctaagtagtatgtggagtgtagagatggtaaagcagtccagttaggttggtttgggcagcgtaagtgtgcatcgtcatgcattaaccaacagagaaccagtgccagggtccacaccaacagttttcaaaataaacagtctcaattagacctgaatatgacaggtgtggtggctcatgcatgtaatcctagcactttgggaggctgaggcaggtggatcacctgaagtcaggagttcgagaccagcctagccaacatagtgaaaccctgcctgtactaaaaatacaaactagccaggtgtggtggtgggcacctataatcccagctactcaggaggctgaggcaggagaatcactttagcccaggaggtggaggttgcagtgagctgagatcctactactgcactccggcctgggtgacagagcaagactccatctcaaaaacaaacaaacaaaaaaatttgacctgaataggcaacagagtttatcacaaacagatagcatagataagtattattttatgaaaatgtggtttcagttatatacatgtgtatatatatatatgtatatgttcatacatatacatatatatttgtaggggtatttgtattagatcatgatataacatgtatttattgtgaattacattcttaaaattgttactgagtttgaaccaagacaaattcgttacatatacagaaagtgccctatggtagtaataattattgcatactaattatttccacaattggaactatagaagagttcagtggtattttatgcactaattagctccatgttttatatttactttacatagtattagcatggcatgcatttgagtgtctgatttatcacactaagaatagatcattcctgacttgtaaggaatgcaatggcagaattgctccaatatgtgagaacggtcactgtggcggttgccgattatggaagccatgagccattattgttaccatgaaaatacgcatgatttatacattacttctactgttgccatgcgtgaccaaataaggatcttttgctttacattgtttctgctggaacaaagtaaagaagttcaacagtccaagagttttcttttctagtccagttattatgttactttttcagaaagcttaggatcttgataatagttcattcctgaggctgaaggggtttcattattaacaagtcagataattttcatttcagttttgataaaagatttttttttaattttgagcaaaggttgaagcacttaatgcttattgtaataattagttttatattttctattttgattgattcattggttgattttgattttaaggatttaaatagctgaaagtatggaccatatttctaggaaataatttcctggtgtaccatttatcctctaatggttactccagacatttaattgtaaatgactagtatcccattttgtaaataggccttgccgagagtttaacaggatcaagcaaattatttttatttttaccatacttactgttgtcataactgctttgatgagagctccacaaatgaatgaatgaacgttataatttatttatctaaatattgtgacatgttactactttttagtaaatttaatttttattccattttttaataagagactaatttttggcaagtttatttcagggaagctatgagtcatctgtctgaacaaagataagtgaatagaaatcatcctgtcttactgaacacgttcaaacagcacccaacaaagaaacaggctagctcacatctaaatttctaattcaaaactggtccagtacaacagaggttaaaaaaacaaagattccagtttctttccagtttccttttccttattaaggtcttagtaaaagccagtgaggaacactttttttttttaagatggagtctcgctctgtcacccaggctggagtgcagtggcacgatcttggctcactgcaacctccgcttcctgggttcaaggaattctcttgtctcagcctcaggagtagctgggattacaggcatgcgccatcacgcccggctaatttttgtatctttagtagagacagggtttcgccatgttggtcaggctggtctcaaactcccaacctcaggtgatccacccgcctgagggacactgcttaaccaacttagtaagttatggttttcttcatatctcttaagtgccttccaagatactggaccccagcatttgctgcttgccacgtagctcagctgatctgttgatagacccccacagagggacagtgaatgtctgctggcattcagggatgccctagctttttctaaccaaagctacagactctcagtagctggaaagcagggacggtatctgccttgttcactgcgatttctctatttttagactcatagaaagtgcatagtaaatcattgttgaatacatgaaaacaccaaagaaagaaggaagaacagcaggagaaagtatacgtagcttgaaacaaagggggagagacataatctgctcagagtttgatatcatcctcagataagagtgtgttatccactcttaactaatacatttgagggtctcttgtcaacccaacagtgtttctggggtgagatctgggctcataggatgaagagcttactggagtcagaacacatacctgtacgcgcacataggtacacgtgtgccacacgcaactctgatcaagttgtattgcagaagcagtttgtgctatactgttaaagaataaggctgcatataaaatggggctaatggtgtaatttggataattagcataaagagtttaggaagagaaaggttaatttttttttatttgagagagagtcttgctctgtcacccaggctggagtgcaatggcacgatttcagctcactgcaacctctgcctcctaggttcaagcaattctccttcctcagcctcccaagtacctgggattacgggcgcctgtcaccacgcccggctaattttttgtgttttcagtagagacagggttttgccatgttggccaggctggtctcgaactcctgacctcaggtgattcacccacctcggcttcccaaagtgctgggattacaggtatgagccactgcgcctggacaagaaaggttaatctgagaagcagtttcccagaggaaagggatgggacttggataacaagggatcacagatggggcctgagccaaggtcagagtgatcatagccagtgggctcaaccaaaggggacaatagtattgggtttggtggacagtaaggtggggcacatggggtagggattgaacttcagagggtggtttaggaaatagataatcctagaagtttagatttaatgtaatcagcataaagaagtcatatttctggagcaagaaagtaatttgatgggggctgtgttttgagattacttggtaatagcaagcaggaggacagctccccctcaggaccagaaagggaagggaaacagcctcctaggactgcaatctcagcaccactttcagtctcactgatggccagctctcctgggatgctttgatgtcacagaagcaactgataaggggaaatgcattcagttttgatcttccccttgagagggtctgaaatgatcaaagagtgaccaagcctacctgatatggttaatctttgtgtccccacccaaatctcatcttaaattataatccccataatccacatgtgtcgagggaaagaccaggtagaagtaactgaatcatgctcttctttcccccatgctcttctcatgatagtgagcaagttctcctgagatctgatggttttataaggggttcttctccacttcactcagcacttttcttccctgctgccttgtgaagaaagtgccttgcttcctcttcaccttccaccatgattgtaactttcctgaggccttcccagccatgccaaactgtgagtcagttaaaccactttcctttatgaattacccagtcttgagcagttctttataacagtatgaaaatggactaatacagtacattagtactgcagagagtggggtgctgctataaaggtacccaaaaatgtggaagcaactttggaactaggtagcaggcaggggttggaacactttggagggctcagaagacaggaggatgtgagaaagtttggaacatttcagagacttgttgaatggctttaataaaaatgctaatagtgatgtggacaataaagtccaggctgagatggtctcagatggagataaggaacttcttgggaactggaataaagttgactcttgctatgctttggcaaagaggctggtggcatttttcccctgccctagagatctgtggaactttgaacttgagagagatgatttagggtatctagtggaagaaatttctcaaaagtaaagtgttcaagaggtgacttgggtgctcttaaaggcattcagttttacgcattcacaaagagatggtttggaattggaacttatgtttaaaagaattgcagagcatacaggctcagaaaatttgcagcttgatgattcaatggaaaagaaaaaactattttctgaggcgatattcaagctggctgcagaaatttgcataagtaacaaggaaccaaacgttcatcaccaagacaatggggaaaatgtctccagggcatgtcaggggtcttaacagcagctcctccaattataagcccagaggcctaggaggaaaaaatggttttgtgggctcggcccagggcctggctgcttcgtgcagtctcaggacttggtgccctgcatgccagccatggttaaaagggaccaacatagagcccaggccattgcttcagagggtgcaagcccaaagtcttgtaagtttacatgtggtgttggggctgcaggtgcacagaagtcaagaatcaaggtttgggaacctctgcctagatttcagaggatgtatagaaatgcctggatgtctaggcagaaatttgctgcaggagtagagccctcatggagtacctctgctagggcagtgcagaagagaaatgtggggtcagagtccccacacagaattcccactggggcattgcctagtggagctgtgagaagagggctaccatcctccagaccccataatggtagatccattggcagcttgcactgtgctcctggaaaagccacaaacactcaatgccagcctgtgaaaacagctgggagcagggctgtaccctgcaaagccacagggacagagctggccaaaatgacaggaaaccacctcttgcatcagtgtgacctggatgtgagacatggagtcaaaggaggttattttggaactttaagatttaactgccctgctgaatgtccaacttgcatagggcctgtagtccctttgttttggccaatttcacccattttgaatgggtgtgtttacccaatgcctgtaccaccattgtatctaggaagtaactaacttgcttttgattttacaggctcatagatggaagggacttgccttgtctcagatgaaactttggacttggacttttgggttaatgctggaatgaattaagactttggggaactactgagaagacatgattggttttgaaatgtgaaagggacatgagatttgggaggggccatgggcagatgatatggtttggttgtcccacccaaatctcatcttgaattgtaatttccataatcctcacatgtccatggagagaccagatggaagtaattgaatcatgagggcagtttcccccatgttgttcatgtgatagtgaaggagttctggtgagatctgatggtttcataaggcgctcttccccacttcgcttggcacttctcctttctgctgccttgcttcctcttcaccttttgccatggctgtaagtcccctgaggcctccccagtcatgctgaactgtgagtcagttaaacctctttgctttataaattacccagtctcaagcagttctttatagcagtatgaaaatggactaatacactgccaaacagccacaatgctacacatgctcacttcaatctcaagcttggtctacatttctctaatgccctctggaacaaccaaatcttttgttaatgagaaggcagacagtgtgagtgtctttttcttgggaatgggtcatagttggctgacattacaaaccttagcctagcttgtgtttttcacagggcacccccttgtgcttttttaaaaatcccactagagaattcacaggctgaagagagagtaccccttcttgagtgtcctaggtttcccaagtagttctcccagttctgtgttagcaagtggcagggtaggatatgggataggtggtagaataggaggaagagggaaaagctaggtcataatctccttaagatcagggacattgccttcatctttgtatttcaagcaccttgtgcaatacatgtgtcagatgaatgatggctaggtgaataagaagcattttgtttcctcattgtcctgttcagatatgacatgttatcaacagcccagatattattcagacactcatcacccttttacctccttattcctcctatctgtttagtggtggtgcaactcatataaatatattcaaagcacatggaacattgactgaggtgcccagcccagtgttcagtaaaggaattgtggatattgaagctactaagttctatcttccagactaagacagtcacgggattggttatttggggaggtggaaactttatctgccgacttctgtccatttcctaatttcatattatgtagtcttagctcctcatttaaaatccacaacttaggccagtcatgctggctcatgcctgtcatctcagcactttgggaggccaaggtgagcagttcattcgagcttaggaattcgagaccagcctgggcaacatggtgaaaccttgtctctacaaaaaatgcaaaaactagccaggcatggtggcatgtgcctgtcgtcccagctacttgggaggctaaagtaggaggatcccttgagcccaggaggttgaggttgcagtgagccatgatcacactgatgcactccagcctgagcaacagagcaaaaccctgtctcaaaaacaagcataaaaaacaaaatgcacaacttattacttcatggacgtgggatatgaaatagtaaatcttgagagtcaatcttctctgtggtcttaattcatgcttaacatatgagcataggaatatccccacttcccatgcacatatgagcacagggatatccccacttcccgtgcacatatgagcacagggatatccccacttcccgtgcacatatgagcacagggatatccccacttcccgtgcacatatgagcacagggatgtccccacttcccgtgcacatatgagcacagggatgtccccacttcccgtgcacatatgagcacagggatgtccccacttcccgtgcacatatgagcacagggatgtccccacttcccgtgcacatatgagcacagggatgtccccacttcccgtgcacatatgagcacagggatgtccccacttcccgtgcacatatgagcatagggatgtccccacttcccgtgcacatatgagcatagggatgtccccacttcccgtgcacatatgaacatagggatgtccccacttcccgtgcacatatgagcatagggatatccccacttcacatgcacatatggatacttctaattcgtgcttacatatgagcatagggatatccccacttcccgtgcacatatggatacttctaatcgtgcttacatatgagcataggcatatccccacttcccgtgcacatatggatacttctaatcgtgcttacatatgagcataggcatatccccacttcccgtgcacatatggatacttctttctgcacttgtgtgaacacttttgctcatctgtgtgagtgtgtgcttgtgtctgttttggcagtcatgctatatttttattcttgacatccttagctccttcaaaagatgtgatgtgcctggcacatggtatgaacccagtaaatactggctgaatgagttaatgactgaacactatgttcagagaacagtaatgcctgcaacttggaaactttacacaatccttgtactcaaaatttaagtggagaaactaagtctatatgcataaaataaagtctgttacaaagtaacataagaataaaataaaattaattaaatatactatggatgccaaaatctgagataggtctcagttaatttagaaagtctattttgtcaaagttgaggacacacttgcatgacacagcctcaggaggtcctgaagacatgtgcccaaggtggtaggggcacagcttggttttatacaatttagggagacatgagacatcaacacatgtaagatgtacattggttcagtctggaaaggtggaacaacttgaggtgtaggtgggacaatttgaagtggggaggggacttccaagtcataggtcgataagagacaaatttcagagttgtaaaaacattgaatgagttagtatattgaaaagcacttagaacaatacctggctcagagcaagcacagagtgaatgttagctgtgattatgattataattatgatgactataattattattagtattgtgaaaggaaaataaatcttggggccccaaaatcactaagctaaagggaaaaagaaactggaaattgcttagggtttgccctaagcaatttgagttgcattcttttgagtttctgattagcctctccaaatgaggccatcagatgtgcatttatcgcagtgagcagaggagtgactttgaatagaatgggaggcaggtttgccctaagcgatttccagtttcttttccctttagcttagtgatttttggggccccaagatttattttcctttgacaatactaataatcattatagtcatcataagcataatcacagctaacattcacactgtgcttgctctgagccaggtattgttctaagtgcttttcaatatattaactcattcaatgtttttacaactctgtaagtatcactattattttcctcattttgcagttgagaaacctgaggactgagaggttaagtgacttgtctggagtcacacagctaaaaagaataaggtcacatagtgagcacaaaatggtattgagggttagcaatgaacattttctggaggaggcaagttgagtcctgtcctgtcccatcactgacagccacacctgtaaccaggggctgtattcacaaatggccattacccatctggccagccctcagagggagtggtgagctgagagagacagtcgtgttgagagcctgctcacatggtgacatggtctggcctgcatacagcactgcagccttcccagagtacatgctaattaattctaagactcctttgcatgaagttctcagtattgactaaactcttcaagggaaaaatctccctatttcccagcaaactcagagtagagctgacctccttcatgacacagcatactgacttcaagttttgaaagaacccagtgggctggtcatggtggctcacgcctgtaatctcagcactttgggaggccgaggcaggtgaatcacgaggtcaggagatcgagaccatcctggctaacagggtgaaaccctgtctctactaaaaacacaaaaaaattagctgggggtggtaacacgtgcctgtaatcccagctacttggggggctgaggcaggagaatcgcttcaacccgggaggtggaggttgcagtgagctgagattgcgccactgcactgcagcctgggtgacagagcgagactcaaaaaaaaaaaaaaaaaaagagagagagggaaggaaggaaggaaagaaggaacgaaagagaaagaaagaaaagaaaagaaaggagaaaagaaaagaaaagaacccaatgaattggtcctcaaaaagtaactacctactgtggtagagaggaagagacacaatggcaaatatatagatacataaatgtactctgtcagcatcaagtgtcaactctgtgccaggaactgttctaacccctggggatttagcactgaacacggcagacgaaaattccgtcctcctgaagcttacgtgggggagaggcagataagagatacagtaagttagaaggtgacaggtgacgtggaggaaaatgaagcaggagaggggctggagtttgtagggagggaggcccccaggtgagtctggatgcaggaaagcagttgtcctcccgactaatttgacagcagagggtcttctcctcagttttctcactttctcaccaagtggcctctcaggttatccggcaaagagactttcaaccctgggccaggatgagtgtggaagcggagtggagcggggaagggaagatgaagttcaggtcctctcatcctataatccatgtggggatctagaggcatcattgtggcagggaggagagatgactttatgacaataagacataggcttcacatttgagcggggtaggtattgatccagggatatgaagatggctaagtcatgtcccttgagaattcccagtgtagtggggaaccacttgtgaagacatttgcttgtttcattttatccaacaggagcttttccacacacttctttaaagaatgcagtttggtcttactctgtcgcccagtctggagtgtattgggccgattacagctcactgcaaccttgacttcccaggctcaggtgatcctcccacctcagccttccaagtagctgggatcacagctaccatacccagctattttttttttttcttgtagagacaggattttgccatcttgcccagtctggtcttgaactcttggacgcaagcaatcctcctgtgttggcctcccaaagtgctgggattacaggcatgagccatcgcacctggcagtttggtagcattttgacttaaatttctgtctgtggacaaatagcatttgaaacgtctatgaaaatgataagataaaacatgagaagaaaacagtttgttgatagtaaaatctcaaaaattttgccggttaggttaagaacaatagggcaaaaactgtatatgttaagtttcttggaagggattccttcctttgagggaaaagcctgttgattcttacgttttcttctctacgaaattaggttaaggatcggctgaaagcataaaatgcagcttagaagttgcccgcttccccttcttccccatctacacccatgcaactgtgggacctctgcccttggctaggagagcttttggcactgtgtcttgctgctggcgcccagactcaattttcctgcatccggcttactgtgttttcctcttctagttcctaagtggctctccagaaccttgactgggtttgtctctggtctacacttctcctatccctctccttcccaatttactaggtgaaaggcacccggtacccgctttgtaatgcacccctactgctcccgacaacacctctccactgtcatgcttaattgtctacatttcatttgtcagaggtccgacgttcactttttaaaatgcaatgaatcattaacatgctaataagtgatttaatatctattaatgaggattcgcaatataaaactgatttaatgtctcaactcactgcttccgttttctcataaaaggaaacagctaagtactacctaggagaaatgatacccacgtgcatgcatcttgctctttcctttaatgcttcctggggttctatcttttctcttagcaatgcactgatacatttatggtgaggcacaagtaagaaagagaagaaaaaaggaatcaccttaggaatccttgagataaccatatttgctttgttttcaactccacacacagcctatttcctgccctgggttattttcctcagaggagctgtggagatgactagacttacacataggtccacagctcccacaaagtcttcaccagcaaaccctccgagttcctcactcccacagctcccacaaagtcttcaccagcaaaccctccgagttcctcactctcattcctctagcacaagttgtgcaatagcctcatttttacatcttgcccctgaagaagggggaagaattacaccttgacagtgactcaaaaaagacagcagatgctgacggggttcttttgattaacaggagttatagaactatgtctaaatagttccgatttgatttgaacattatattttatcagcaaataacatgtgtttcattgtagaagtaactaaaacaaagcatgaaaacatgtggttctacaatattggtttttttgttttttgttttttgtttttttgagacaggagtctcactctgtcacccaggctggagtgcagtggagtgatcttggctcattgtaacctctgtctcctgggttcaaggaattctcctgccgcagcctcccgagtagctgggattacaggcgcccaccaccatgcccagctcattttttgtatttttaatagagatagggtttcaccatgttggccaggctggtctcaaactcctgacctcaagggatcctcccacctcggcctcccaaagtgctgggattacaggtgtgagccactgttcccagcctggttccccaatattcttttggcttgtttaattctgagtaagagagtccaaaatagggttcaggacattcttttcccgagatatccccggagtgaaaatgagtgttggatgatcactattttgggtactaattgtttgaccagtattgaacagctgagctccaggggtagaaagagatctaaggcttgtccagtgaggattcccaaagtagtggggaagcagatacaaaaatcagttaagttgtgatagagtagtaggtgttgcaataaaggtatacccacagaacagagagggccgaggctagggaagcttgagcaggattcagactttcattaggcacagaggcgagagagcagctcatggcaagggcccagaagctgcccactgttgtgtctggaatctagtgggaaagggcaaaaggaagtcctggagcagcaggttgcgagcaggccattgtgccaaggagtctggtcttgatcctataggtagaaggtggctggtagagtttaatcagcagaagaaaaagaaatgagaatgggaatgtgagttaggtgacaattggatgaagatggaagcctcatgtcaggaaaccaattctgcagtggtctcctggcagaaggtgaggcagacctgaactgagcctacctcggttagtggccaagtctgctttaaattcatcccttctgccagatggttttaaaaatgcatgagcccattactgaaaaacagaacgtcttcgaagagaaaggcagaccgggaagccctgagtgagaagtacccagtgaaaggaagggcgtttatcaatcctctctctttgaactaaattcattagtgaaatctgagaaactttggagctttaatgaatttgaaactggtgtttccctttatctgcatctagtccatttttaatttgcggtcatctattagctgatgaaaaaagaaaaatgtctttcagcagttgaagacagctaatgagaatcaggctctcagtgtgggcggtactgctgatgtttggtttgtgagagatacaggaatcaacttgttgaagctctctacttgtcagagcacctttaaataatccaagcccagagttgtttcatcttcaggcaagagaaagtgaaaatggcttcaaaggtacaatatctcaaataaacactataaaatgcatccacacttgcctttgaaattgtagtggttcaagcacacagagacaagcaacaatgtttatttcctgatactaatgagcttgtctgtctttgtctatgatgattgttcttagagacaaacaaataaaaatgcgaattatatctgactgttctaagaagaaaagattgccagactattgtattttttggcagttatatgcttcaaaaaactgatcgttttctcaattcctaggaagcgggcagagaaatcacattcctgtggaccaatgctccttagtggatgagttttgtggcatggtggtgatttagttagtaagaagccctgcctgttttctggagagtactatacttgtcgaaccagctcctaggacagtacagggttgtgactggtgttttggggttctctctgcgcataagccctttccttttaatacaaacagcaagatcatcctgttcagcagttgacagatgactgtgtgcaccaaaaggcaacaacgatgaggcaactgatgcatttgtaactcaatgtctcactgaattccagctttcttttctcaaggtggtgaaacaggaagcaacatcccatcaggaagaacctgagggtgccatccagtagcttcgcctcacgtcactgactgccctcagtcagaaatcttgactcgcaactttggagggtgggtctctgaaggaatttcaggtcttacacagagatgagttgtgctgctctctgaggagaacgaagctggttggaacgttggaagctgctctctgactacacttcacaagcaaggggcaccttttgtggactgacatttcagaaaggtaggcgccatcccatggatgtggttagtatttgaggactttcaaaaccaaggtggccgtgattccgcgtgtgagcttgtgtgtgtatgtgtgcctgggtgcgtaacagagagggagaggagatggagattgggggagaggcggacaaatgaagaaatgttcatttttggtctgatgtttgggagaaatacagaaaagacagacttggggccctttgctttgtagagttttgcttggaagtgtttagtagtagagggtaaatttcgagtccaaacttccactcctgacctgcattgctctcgggcgagtttaaactgattcattgagggttaggaagaaaggtctgggcagtgaaatcacacacggctgaatgctcagcatagcttggtttatcaggaaagccctgaatccaggtggaatgaaaggggtcagcacagatctttgccaggtggcaaaggccatttcagaccatcccagagtgccttaagctgagaacaaggtgggacttgctcaccccacagtggcaggccttcctaagctgcttctgtcttgagagatgtagtgctcaatgtcatgccaggagaaattagctgttcggttctaaggctgccagtctcatgcagaaaagtgaaacaaaatcaaactactttttctgatccaagcaaatgtttagcaagaatgttctgttaagcatttttatttttttgaaacctttacacaaaacaagggaaataaagctttagggctgaccagataatgaattttaatttattcattaacccacaatgttcaagtgccttctctaccttaagtgagtgtttgactttaaacttcacattttcattgccttcccccctacaagccttttgtttttcttaaaaggggtttccatttataatttcttcagtagaatttctggataaaaagttctttaaagagaaaatatgtatatgttcaaaaaggtaataattatgtggccctctcattcacaatatttctgcctttttctaaaatatcaatcaaattgatttacataagtttgaagatcattctgggctaataataatctacatttactaagtccttgctgtgtgtacgtgcattttcccctttagggctcatgatacgccactttcagacgaggaattgaggcttagtgagatttacagtggtacagtagggatgtgagaaagccacagctttattgcatttctgcacactaagatatatgatttcagctcattctatattcccattctattccattaaccccctacagggtccttgtgtggagggattcctgaagctatgataatattcaaatactcgaatttggtgtcttataacaaaaggccaaaatcaatcaatcaatctatcacctgcttctgctgttggaggaaggcttggtgtggtggacagaacattgactagaaagacagatcaaaattcaaattcctgcatcctgcttactaactatgaccctggcaagtcactgaaattccttttttatttttttgagatggagtcttgctctgtcactgaggctgcagtgcagtggcatgatcttggctctctgaaacctctgcctcctgggttcaagcgattctcgtgcctcagcctcccaagtagctgggagtataggcatgtgacaccacacctagctaatttttttgtagttttagtagagatgggggtttcgccatgttggtcagtctagtctcgatctcctggcctcaagtgatctgcccacctcagcctcccaatgtactaggattccaggcataacccaccacacctggcctcagtgcaattcttcaaatctcagtttccttatttataaaataattattataacatccatcaaacgaggttgtttattataagacataaaaaggcagggtatgtcaaatgccttccataggacctgacagagggtaggcccttggtaaacagtattcatttccccattttgcagtgatttcttcatgctcttgacatgttggatcctgttctaggattgggggtatcaccagtgaacaaagcagacaagtccctgccctcagggagttgcctttccactggtacttgttccttatatcctagtgtactttcttgggaaatcactttgtgattatctttctttgtggagctgatccagctttcaaacagcctcttaaagtaatgaatgtcctatgccaaaagtcccccaaagcatagtaaaatcaagcaaaaagcaagaacatcagatacttctttttcaaaagtcagtttgttgtggtaggccaggaaagttgtttttacacacacacacacacacacacacacacacacacagtttatgtaggttttccctggcctccacaccacagcagaagcactgccaggagctggcagagtgctcatgggaggagggtgctgggctggctccaagggagctccctccgctcacagagcacggagtgtatcgtggcaactgttcatttatcttgggccccaagccatccacacaagaagcttggactttccaagccctccccaacacgaatttatgggatgcgatgcaaagattgacctgcaggtgtacacctttataaggatggatttgggacaaaaacgattgacttatgttttggcaaaaagcctgcagtcaagttcatcaagtaggccagctggcatcaagaatggtgttttggcaatctatctctatgtttgaatccagagaaactgcagatcatagcagagagatagcagaggggaacacagagaagctctctctggaatcagatgcaggtagattcttctttctcctggaaacacctcaacacacaatacaacgatctaattgatcttatacagcccgagtttatggttttatttactggatggacccaggatgattgaaaaaatccttgtgccaacactagacagaccagacagttggcagtatgaaagaaggcattctaaagtagtgggacttactttcctaagtcctgtgcaacaatcaagcccatcattttacagccatgctgtatgtgctgccttaagatttgtccttgtagctggaatttacaatgatgaaaacataaatgaagctaaaagtctaattaaaataaataaattagggcttatgtataaaaaccccaattggcaagtgaacggagagattaagaatctttgaccttgtaacaaaactgtaacagccacaattctccacagggctttctgttgatggtggacagatgttcaattgtaaatgggcttcagttagatcacttccaaaggttgttattatcataatttcaaggctgagaatttccattaataaatagaaaatagctctgataagaaggagatttggcttggatgtccatgaaacaaattttacctttcccaaatatgagaatttaaaatttcttcatctgtgagtatcttcctgctacttaaatataaaattaaagggttctggttatttatttttttggcctacctgcccactggaaaatctgtggagatgatttgtgctggtggtggattatatgtttcaatctaatggaaagtttcctctttattgttttctgagttaaatatttaggaaataccaggaaactaagatatttaaccaaaattcccaaatctgtctgctcaggattggtaaacacacactcacattcatacacatgtgtgtatgtgcataatatgaaaacacaaccaaaagatgcatacatttctcattaatggaaaaagtgtaaaattcacaggtaaggcatatatttaggttatttggagaggtaaaatattacattaaggagcttgaaaccacttttacttactatattcaggttctaagatgaagtacttagtgaagaaaaatcatatgtgataatccatttaattctctgctgggataaggtctatttgttttattttgatttctttgccagacatattttactggatagtcaataaatacttgttgattagattgaccctgacacaggctgaacaataaactaatcatttcaaaatttaagcaaaaaattctgaaaacattttcttcaataatgaagattacttgacatcatttaataactaacttggcttcaatttcttcccctcaaagtttgttttcttgtttgacatatgattaaaaactttaaaaacatacaacatgctgatgctgaacaaatgtcaaattctgcagattagcaattttcatttgtaatgttcacatcagaggatcattactatattccactttgggtcaaagttacagggtttcataatgagctattcctatcccattagctgtaacttgctttacctggcttgattccaacagagatccgccttatgtggaattctggactataactaattgtgtaagagtaaaacttcagagcttttctagatgatgactataaaatcgtatgcaacttgaattttcctaagtggttgttgtgtagattacactattgcagtgattttcaaacgtttttaaccattactgttagtaagaaatacttttcagatctcaacttaggacatatatacacacacaattctgaaataatagtttcataaaacaatacttataggtattgttttctatttcatttcattacactctacaacatttctggtcataaccgactaattaattttgtgacctactggtagtggttctcaatactgtctgaaaattaaaatcaactagggaacaatagaccaatggaatggactaagatgctagaaaaaaaacctccacaaatttggacctttgatttatgacaacattggtactacaggaaaggacagacatttgaatgtccatgtacaaataaatgagtcttgattctcatcttaaaattcatacagctctaagtattaatctagatgtgacaggtaaaacaatataacttctagatcttcactgtccaatatggcagctgctagccacatgtggctattgagtacctgaaatactagaaaatttaaaattacatatgttactcccagttttcttcctactgaacagcattgttctagatgacaaaacagaatatatgtatgaccttgggtagacagtgatttcttttttttttttttttttttgagatggagtcttgctctgttgcccatgctggagtgcagtggtgcaatctccgctcactgcaagctccgcctcctaggttcctgccattctcctgcctcagcctcccaaggagctgggactacaggcgcccaccaccatgcctggctaattttttgtatttttagtagagacagggtttcaccgtgttagccaggatggtcgcaatctcctgaccttgtgatctgcttgcctcagcctcccaaagtgctgggattacaggtgtgagccactacacttggcgatttcttaaacaagatacaataagtactaacatgatgaaaaagatctgtaaattggttatgttaaaaataaggacttctgtttctcaaagcataccactaaaagagtaaaagacaaactgcaggagaggagacatttgccatgcaaataacatgtaaggagtcatgcatataacatgacttgttatgcatgtaacaaacaaggagtcctatccaaaacagaaacaaggcaattttgaaagatagaccgccacaacagaaaaatgggcaagaggtttgaacaggtacttcacagaaaaacatattcagacagccaagagacttgaaacatactcaaccttgttagctttctggggaatgcagattaaaactgcaatgaagtaccactacacacccaccagaaaggtgaaaatttaaaagacagacaatagaaattttggcaaggatattaaaccactggaactctcatacgtcactgggaggagtgtaaatagtcacaacagctttgaaaaactgttcagcaatatctgttaaactgaatatacatatgccttatgacctggcgtttccactcccaggtatatgttctacagaaatgcattcacgtatttacctaaagcatgttcaagaatgttcaagaatgttcataaatggcaccttgaagtgttgtaatcccaaactcaaaacaacccatatttccatcgacaacagaatgggaacacagatcgtgatatagtgatatagtcatgggatggaatattaaaagtcaacgaaaatgagtttgctactgttacatgcaacaacatagatgcatctcagttctaaaagttgagtgaaagaatccagatgccaggaatgtgctcaaaacaatcgtatttacataaagttcaagaacaggcaacacggatccatggtggtgacagggagaggcatgaggaagagtctggggtgctggtcatattcttttgtgctttgtttctttaccatctgtatgttatacttcaataattatattacagtaacaatacagcagtgacaatactgataccaggactgcaccttcagagatcttggtttagttgatctggttaggtagaaagcatggtcaaaaaatctctcccaaggaattcacatgtagaaccagggttgggaaccagtgcactaatggtttacaactggtcctttgaaaacccatgtgctatgacaaactgtaattgttacaccaggctgtgctaggcccttattatctctgttcaagttacactgacttgacgacataattcatattgagaaatgttagcaacataaggagtcacaaagttaactgacctagaaagccggtcaggtgcctgaaaacagttggccaggttggtaagcgtgtgttccatttaagggctccagtgattcttgccagtcttctgagtttctgagtgaagctgcaaatctggatttctatgtgcaaattcttgaattttcagtgttggctcaaattgttttaaagccccatgcaccagtccaaactgattggtagacccaaatttgccagcaccaagctctcccgttggtttgaaactctgacttaagttttagacctattatagaaggacgcttatgggcacagttgtgtaatatattaattatgtttctctttttctgcttctttagggatgttgtgaaacaaaagctgacatttatatatatatacatatatacagtatttgagttcctcagtagaaagctatcatatatactcaggtaattatctttattttattttattttacctctactgtgttttcttaactataatcttgggaaattaacatctgtgactcagaagttgatatctggcattgttttgcatattctggggacaagtggagtttgggcaaagccagtaccatgctattctttatgaaatactatagatttgtattctttccttttgaaagcggagatgcaggagaaagcttcatgtgacagcagcaggtagcaaagagccatcagggggtggcatttgctgtctgtgctctggtcttccacccccataacacctgctgttctgatgggaaggaaggaagagctggctgtgctgggcaggtctctagcttccagcgtcttacctgtaaggagaaactttcaaaaccacattccttcaaaatcataaaatatgaccccaaatgataaaaaatcatcatttgtacgaggaagagtcattcatgaagcatgttcgcaaatattgacttgatgaaaggcaaagtcaggtaacgtagaggggaggagttgcacttttaccgttaatgcctaaatttgagtctggctctgtatcaccttgagcagtcactttatctctctaaacttcattgttcacctgcaaattggaagcatgcataattattattgttgtaaggattcaatgagtgtgggtgcaacattgtaagctgtggtatgtacagttgttcgttataattttaatcatcttatttactttttgtaacggtctgtgaaaagctggtattattattcccggttttgacctgcaagaaccggatattcatgctgctggatgcctgatcccaggtctatgctctcccggcaccagctgtgcttgctgacacagagcttcccctcctccccaccctgcccactcctagtgggacagtggagggctcaggcagaaggggctcccatccaaggcaacactctgccttgggcctgtcattttctacaccttaccaaaagttttgctaaacagcaaaggcagtttatcacacatgtattttcccagcctgctttttagtgaaggtgacagtggtgaagaggtagcctactgggaggaagagaaggaggaagcattataagccacagagtgaagaaatacttcctgctcacaaagaaagtgctcgctgtgagaaggagcagttcagcggggccttcaggagtcacatgaagacttctgtcttggtcatgctaccagcccctctggtggctacacagcccgaacagatctttggcttccagaattcacaggaattctggaggttcagacctatcccaaggccctgtggacaggcctacccctaacatttgcaggacacagggcaagaatacaaatggaggcaccagccctcagctgggccctgtctttcctcccagcctcacttatgtcctgctctgctaggagcctgatgtgcatgtgtgtggccactgcatgctacgtcccctgccttcccctccccaagtcttctttgggccttctccaggcctagcattatgctgtgctgtcacttttaagaggacagacctagaaaggggcccatgcaggtcctggaagtgggctcagagctgctcaggcagggaattctaggatccttgatcacctagcaagtctggaaagggggcatggatgtgggtgtacatgtctccttgaacctatggactcctcacccaagggagaagtgaggccagaggagggccaaagggggctcttttaaattaaagccagatgtaagggtggggctgctcctgaggatcaagcacagggtcctggtacacagttggcacttaatcatacctttgactgttgtgtgacagagggacaaaggctgagcaatttcagaattgctgtggaatatctaagtattgctcttcttccacctccatgctccataaacatcgacctagcagcatggcaaaggttggagtggctgggatttcataagatggcagatgagtaacattcccaaccttgtgtactagcaggaagagcaatttactgagaaacagcttcactgggcagggaagagaaacaatccaaggctttccctctccccaaacaagaggacatcactggggctcagatgggtggcgtctcttggtatatttttagaatccatgtaggtttagtgtctttcgtatgtatattccagggagtagctggtatatttgaagctgaatatcatatgacccttccgttcacttttttttcagaacatttctttcctttagagcaacctaaagacatctatatttaaatttcatgaacatgaataacatcgaggaactctgaatcccctcacacagcacccagagctgctgctggaaggtggggatgggagtgaagggggtcagagtggtcacttcaactccaagtccacctcaatcactgtctcatctccagggttctcctccacaaaatgtggacgtgtgattcacagtagcactttggccaagtatattttttggcggattttttttttttttgagatggagtctctctctgtcgcccaggctggagtacagtgacgcgatctcagctcactgcaacctccgccttccgggttcaagcgattctcctgcctcagcatcctgagtagctgggatcacagatgcgcaccaccacgcccagctaattttgtatttttagtagagacggtttcaccatgttggtcaggctggtctcgtactcctgacctggtgatctgcctgccttggcctcccaaagtgctgggattacaggcatgagccaccacacccagccaggtggaattttttaaaataaaatatccaataagtcttacagaaagcattttaaaaagaaggcttaggaacacattgaccccaaatgaagatcaatagagcagaatcagaagatcacattgccacatgtttgatcccccagggaaaaggagctgataatgtgcctggtgtggtgtcgagctaggaaatcctgtgtatgttagcacagtatcgtctcacattcacaccagctgattttcactaataggcagagagatgacgtgaaaattgtgtaaatgcatattgacagaaatttaaggatactcctttgaaagaatgtgtatttgaaaagtctggaaatttttatttttaaataatatgttacattttcaaacaatatgcccaagactttttctgccagacatctttgcaagtgaagtatctgtaaattcagtcatagatttaatcattaatcaaaaaaattgaataaatgaaatttattctctaatgttccaggcaccgcagatatcctgtatgagccatgctctctctctctctgtccttctctctctctgtgtccctgtctctctctctcactctctgtgtgtgtctctctctgtctctttctctttgtccctctctctgtctcagtcattctgtgtttgtctttgtctatctctctgtctctgtcaccccctatctatttaaaatcggggtgttttacatttttttctttaagaggattcttgcattagacagggctagacagaaaagactagcctttttccagtatgaggtcttacgatttattttctcttggtgagtagttagcaagggctggtgatcactgacagagggagcagctgccctggccagagagatgaatgacccatccccatttgctcaaggtagaaaacagtaactattccaacaggtgcctaatcccccagcccaatgccattggcccttggccagagatattgctctaacttttcttgtgatttcggagtctgagaagaaagcagttgagactatatttggggatgtttttctgcactcctgcaccatttccctgcctctcctgtaaacgctcacacccactgcaccccaccctcctccaagaactaggatctttgtcatcttgttcttttccaaggggtgctttatcttgcgggggctgtaggctgtacaacaggaaaccctgcctgcaaacattacataagaaacacattttaaaatattaaaatttggagcttgcttcatcagtgtaccttagtaaccccaaatcctttcctaaaagtgacccagcttcctctttatctgtgggcaacagagagatgttccaaattccttcttgatcaaggtcctactctttttcataaaatgattcctttggtggcactgcccaagcaagtttcatgaggtaagaaatcctgctgtcactgaggaaatcaccccgcaaaagacactatccctcagaaaagccactcccccaccaacacttggtcagagtgacctaaaccctgatcagggtattgtaggaaatgagggactgctggctggccatcgtaccacttggaggcacagtgccatcaatgaggaaatgtaaatagtgactgcagtgtcaatgccaacagtatatagggcacttgccatgtgccaggcattacattaggtaactgagacacatgatgtactttatttaatcctgatctagaacttacaaaataaacataaaatgttgtgtctatttttacagactgacttgtcctagatccgttagctattcagtgacaggactgaccttcaaactgggcttcctgactccagagccacagttctaagctttcaggctctgtgaggaattcagggcttagaaaacatcgcttaccctaagccatgtagttggaaagtggtgaaagtggcattcagattcccaaactccttttattagcaggtcgctaggtcctgggttctcacatgtcttgtcctggaaatcctactcttgtttgctgaggttgggagggagatctgggcattctcccaggtgaggcccatctttggaaagcttggaaccacctgacattgcaacacagcctctccaggacctgtccctgggtattttacttagcacagttggtacccattatgtgggctttccttactgaaagacagctgtgaaaccagttatctatatccagtagtgagagagatgagaacacaatgggggaggaggctatgaagccacaggaggttctcccatttctctctctggggaatcttttaacttagtatttaattttattgtttaaaccagcctgacatctgattctttcctgtacccagtaggtgacgataataagatgaggttactgtataacgcttacccagcacattacagtgttcaagtatgtctgtatacctaatctcccttagtcccacgacaggtctttgtggtaggtggaattaaccccatttaacaggccagtaaacaaagattcagagatattgagttgcctgagatcactcagctattaagtgacaggactggcccttaaactgggtttcctgactgcagagccactgttctctcgaaagtttttaggcaagacttacagctgcttgtggtatatgaagtgctgcattcactcattttggtttgttatttttattgtgtccatcaattgccagcttgcaatctgtataatggccttacccacccctttctaaccggatgagttgatgggaagccagtgcagcacccttgagtggcacacaggaggtctttgcagacactaaggcaatcctttagtctctcaaatgggaaaactgagacagaaccaggtgactaaccttaggccctttgtgacttactggcagcaggttcccaactcctttgctctgccctggaccagtcacttgtgcccgacactaataacagggtaatttgtgagaaatgatgtgtgactcaccaggcgagggaggagagttcgcgaagatggccagtgaagaggagcaagatgtttatcagcaattggaaaggaaatgctgacagatgctccttggattaacatttctcagttttgcaacaccattgcctacttacccagccaccagcttacattttacattcctaaagtgaacaaccaaaaggtggggaggggagttctgcctttgaaaacagaactatcaatctcatagtgttcctccccatcaccttggacccctttttttgaaccctaagatttacattcttctaagacctatctgttctgtgactttgctttacacccctctgacttcagtcatacctgtttttctgcaaatttctatccacattactattctaagtcaacttcctgcctcacttacctccctgggtcctgagtgggcctttggcaatctctgtcaaggtaatgatcaggccaagataagcccaagcggattaaggtgaaggggccttgggagaattccattttggtgagcactgcctcctggaaagccatgtgctattgtgtctttattacctccacactgtaaagtcattttacaggtagatttcaagagcctgtcttcctactgactaagggagtacactttgtattttctctgaaattgttaaaatccaaaagattccaatagttagctgtttgtgtgagtaaaatggctgtgataagtttttatgtaggtaacaaacttgccttacttcaaatcagtttaatccacatattatctgtgtcaagccattagcttttgtatatgaaacatttactataaaaattagcctcttaaaaatattaatgtgaaacaaattaccatttagacaggggaagctaggtgtgtattggaaaaacactggctttcctgggtttactcagatacagcaattttatttccctgggactcagtttcttcatatctatagcgctgggctagatgttgcatgatttttagaataaaatttgctttcactgatttgaataatcaaataagaaaagagtgataagttttcctaatgttgaatcagtgataacaatattttaaaagtttaagccacccagaacttatcatgttagtatatcaattattttttatgtttctttctagtttttttatacccacacacatacatgtgatatgtataaaatagtatcatataatgagatcatatttatcatataatcatagtatgatgtaactttgaatttggattttactttttaatatgtcattaggatttctcatgttgataaattttataatttctaacattagctggatattattatctggagttaatatttcaaatgtgcttaaacattctggtctttaaaaaactaatattactaacattgaagtgttatttattaactgtagctttcaaaaattgtgtccagttttatgttttatgtatattcccaggtacacttgaacattttagtgactcctaaaatttattatctagtttccaaaaggatagtatcatttgtgttgccatcagtaacagatgcatgtagtagttttactatatcgtagttagcactgaatattatttttaaataacttcttctaacttaataagtgtcaattaaagaattttaggacctggaagtttatttagttcccttccttagaagggcaatttcatggtatttaatagtttgactccaatttatcatttaacagacatgaaataaagcgatttacaagcatttacccacttactcattctaacaaccctgcagggaggtacaatgatcaactccatcttgtagatggggaaactgaggtcatgctagttgtccatgggcacatggctagttaagtgtcaaaactaggctttagacctgaggagcctggctccaaagtccatgtgcttgaccgctgtggtatatgtattgagcacttactatttgtacacttactgtatgccaggttatggaaccttgggggatctggggctctggaaagactagatgaggatcttatagatgcttaaatggagacttgaggtgaaggggtgagcagagcattctaggcagaaggaatggcctatgcacatgccacaaggctaaaaaaagaactttgacagtaattccagcactttggaaagctgaggtggaaggattgcttgagcccaggagtttgagaccagcctgggcaatatagtaagacctcatcactactaaaaatgaaaaactagctgggtgtggtagtgcatgcctgtggtcccagctacttaggaggctgaggtgggaggattgcttgaacccagaaagtcaaggcttcagtgagccatgatcatgccactaaactccagcctgggtgacagagcaagatcttatctcaaaaaaaaaaaaaaagaaaagaaaacaagaactttgccttttgctttcaaagattagaaagcagacccctcacagttgcagtatcacagactgaggggaagaggggcacagaagaactggaaaagtaggcaggggtccaaccgccccgggccctcctgcaagcatctcagttacaggagagtgcagggagagggaagacagggagctgcctccagacagaggtggactcattttggagaaaaagcctctgacacaaccttccccaagtggagtttcttctgcatacaacaggagacagcagtagccgcctggagcatttctaagaattaattcattgggtcaagatttaggttaggaaggggctgatagatggcaacctagatcacagtatattgtggagttttattacagagccaagagaaacacatcttgaagggaagaccatgaggggagagctctggctcgaaagggaacttgaccctttcagatgccaaatgtctaattggcatttttgaggtttattagttttgctaggaaaatatcccaattatgtttagtaacagtgagaaagtattgccctagtggaaagtgacagctggctcatggagacattaaattttggaatcagtgggagcaaaagggcagaatcacatcttcctgaaacctcaagtcatcacctaatttataagcacaataaagtaaagcaaactctaccaacagtgttaggagggaaaatgagggggctctcccttctcatttggacttccgaggccttttttgacttgctcagaataccctcagcctttgatatctagtattagagtaaagcacataaagatggttggacttttccatcaaggcacactgcatccagtcaggattagagtaatgggagattggctagtaacaactctgacgaatataggactagcaggtataagaagcagtcacacctctgggatattgagcacccaaggaagaggctccccacaggctgacatgcagaccctcttgaaaggagtctttatggtaccagcggaacttgctggaaaccagccctctggaacttgccataaatctgccctgtagggttctgggagagctgctcattagcaggtatctccctggaggcacgctgccacaacacccccaagggaggtgctgaaatctgctggcagctgggggttgctggagcccttcactgtgtgccccagatctcaaaagcaaaaccctttcctcccaccatgttgctacatgaccctcttctgacaaagcttcctgaccagctggcaaagggaaaatatgtaaagggattggatccattttccccaagcaggcaaaaaggatgaatttggagttgagaggcattaacttgacaactggcccaagcttcaagaaagaagccctgtaagaagagcaaagactcatgatgctcctctccagggcatgtaacagagcattaatggaaacccaggctcccagtggacttacgatgctcctctctagggcatgtaacagagcattaatggaaacccaggctcccaatggacttacgatgctcctctccagggcatgtaacagaacattaatggaagcccaggctcccagtggacttacgatgctcctctctagggcatgtaacagaacattaatggaagcccaggctcccaatggacttatgatgctcctctctagggcatgtaacagaacattaatggaagcccaggctcccagtggacttatgatgctcctctccagggcatgtaacagaacattaatggaaaccaggctcccagtggacttacgatgctcctctccagggcatgtaacagaacattaatggaaatcaggctcccagtggacttacgatgctcctctccagggcatgtaacagaacattaatggaaacccaggctcccaatggacttacgatgctcctctctagggcatgtaacagagcattaatggaagcccaggctcccaatggacttacgatgctcctctccagggcatgtaacagactgttaatggaaacccaggctcccaatggacttatgatgctcctctctagggcatgtaacagactgttaatggaaacccaggctcccaatggacttatgatggaaaaagtccctggattatttttttaaattgagttatagaagttctttatatattctagataaaagttctttgtgttgcagatattttctcccagtctgtagtgtggcttttttattctcttaatgtttctttttttgttctttgagatggagtcttgctctgtcacgcagcctggagtgcattggtgtaatcttggctcactacaacctccgcctccagggttcaagaaattctcctgcctcagcctcccaagtagctgggattacaggcaccttccaccacgcccgggtaatttttgtatttttagtggagatgcagtttcaccatgttggtcagcctggtcctcaaactcctgacctcagatgatccactcaactcagcctcccaaagtgctgggattagaggcgtgagttaccgtgcccgaccttaatggtatcttttgatgagcagaagtctccatgttttacagtctacctggaaataatacaaaccatagctcttgtttacttatcttttccattattttctctgtattattagagtcacagtctcacctgttgtaacaaatagaactcaaaattcaatgactaagatagaaattcatttctcttgcatgtaacagtacagacatgaatggcccagggctaatgagttaattggctttaaaaatcgctcctgtcctgtcagccacatctccagctatcaggaaggcagagagaaaccaggacatgcagcttggtctttagggagattatgcaaatcaattccacccctatgtcattgacccaggcatagtcacacatgccacatctggggaggctggagaatgctgcctcatggagcgggcagccacataccaggtgtaactggggtggaggctgggggtgtgtaactaaaaagaataaatggatacttgggagcatcctgatatcacttaatgacatctttgaagtgataccatatttttgtcacaaatattctgaatttttctttttttttgaaactctattatgaatttcttccaggctttaaattaatataattgttaaattttgtataggagaattccttaaaattattttttgtcttgtagtaagttaattgctcctcttcattacagtataggatatttttcttttttttctctctcttcagtttttttacagttatagcctaaggcattcatagttttgttaatgcactaacttagaaacagtaaatatccttcaaggttaagttgttctatcatttgcattgtcttcttcatgtgaaatggtacaattttaaatgcatttagaattggaatttaccatgggcttggtcttaacactgtgcacaggaggtgcgtagctgctaatgttttcctttgtgttttatcttaaagacatactatttttttttttttggctgggtttgtagagctggttccaaagaaagcacaaacagactaatgtagataaacatgtttacccgaccctttaaccaaattttaagaattgtttgacaactaataaaaatgaagttgtttttagataattaaatcagattttattattggctgaagcatcactctttgagtgttcaaaaatgcattctagccccagtaagctttacatccattcattcaataaatattcatttggtgtctactgtgtggccagctctgagtaggcaatagcgagcaagacagagaaggtccttttgttacagagctgactttcccttcaccagagaatgccggtcacctataacctagctggtcacctgaccttcaaaagctcttgccaactcatatcctccaaccataataatgttcagagatcgcgaatgtgaactcaagcgcatccttgcactttgtcagtcagaaaaatacctttacttcagtttgacttgtttgcccaccttgccatttcttgttcctgctgtctgtctgagagaaaccttctgttctgtagagatagtttcttgttgctctcctctatctgagagatatgttctgtagcaatatcttctaaactggtatggaatttacagtatgaattggatgaataattaccagatgttgtccaaagcctcagcttggattggagttcttacatcagcaaaagttagactgtcatattttttaatactttacaaaaatgttgcttcaaatagtgataaacttgtggcccaactggttttattccttccatcctaagttcgaatggaatggcgtccatctgaggaagtagctcaacaggcttcatttacacattgggttctatacccacgaggttagaaaagaatgaccgtgaaccccctacattagctacattgtcttcttggaaacttttggcagctgaagtcaaaaatagggcttaagaattccatagtattagcaaaaaacacagctggggctgagatgcctcatccgttactattgcttcccccaaagtacaaagaaataaacgcaggcatttttcttgcaaatatttcatattttaaaaaatagcctcagatttttttatgtaaataaaatcacaatttcttctgatatttttacatgagtaaaaattgcagaacttagagaatgcacacaggatgagaaaaaggggccttgagtagctgaagagagaaaaaggaactgagaatgacccgggggtaaataagtacatttgcttccaagagaattccaagcagagatactgaggagctgttaacagagtttatttttaaattgccagaaattgctagaattgggtcaaatgactaaagatgggacatgaactaagaacttaatgtgggcatcagtgggctcctgagactgaccgaaaagtgagtgagtcaaaatcaaggtccttaaaggacagaatcattgctgtgaaggctcaagaatttttcacagcagtgacatgtggggttttaaaaacacaggtatctctccatctcgatgttttgtaactgtcctttccatctgagtattgttgaagtattgcgatgcttacacagttaacccagcacaaaagtattgttctactgacagtataggtgatatgttttttttcatctaccaagcatctttttaaggctattcagggaagccagcagcctcctttacacggaaaaaaaccaccttaagcagtaactaagagtgtcattatcacatttccaacaggaagaacaggggcaaaaatgggagagaaagaagaaaaagagacaaatgagcaaatgagtgcccactgtcagcaagatgaggtcagaggctaaacggggagaaactgacaaatgctgcaggctgtgtacttctcagttataaatcctaaaaacaggtacctctgctacacttacggttcagacaaccaaattggagtcatcagtttctctaaaggagggtgtggaagatgctggatgtataagttggggttcttggttgtaggcaatagaatctacctctttcttagtaccttaaataaaatacttcattggaggcaactcacatcattgaaggaaggctgatggactagacttggatgacagtggaaaccaaggcaatcaggaaagccaagaagctgagagaccgcgactatcttttcctcagcagcagtcacggccgccgctgcctcggcaggatgccatctgctgctgctgctggatagcattgtctgctccagattcaatcccaacaaaagcatctgaatgaccagatctaaggtcaggccaatgccagcagatggagaatggccccctttggcattcacaatgggaaaggcatcgtaccaacttcacacctggtggcaattttcactgactactatgtgggctggatgctgagctggtggcatgtccaaaatgacatgtccagtacactaggatcaggtaaatgtgactctgaaagatcccagaggttctggctgtggattatcacaggctgtggcctgagagcagccatggtgaggccatgagaatgtcacttgtttgttgctaacagtctgaagtagcagagaggattagagaagagtgactgtcacagtcttcacttcctttgtgtgtttagcctctgatctcatcttgagaaaagatgaggctggctggaggggtagcctggaccattaaagcccatgcctagagctgaaatattggcttatggagtctatgaccacccttatcttcaaggggccatcatctgggagagacacttcttcaggagagttcaattttgctttttaaagcatactgtttttttcttccataaagtcataaaatttaaagtcatgctgaactctgaacctggttatagtctttatttcttttatttatttttcggggttcgtggatgcaagcttgactcaggagaatttgggaggtaaaacttaagcaccataaatgaagaacaggcagctgcagcatgaaattcaggataagccatagattaaaaggtgtaaaggttaaaagttgatgaagctgagaaggaggcttcttaacttttttatttttttggaggtataatttacataccatgcaattcacccatttaacgtgtgcaaaatgcaatattttttagtatatttacagaattgtgcaaccaacaccacattcaaatgttaaacattttcaccaccttaaaaagaaaccctgtacccatcagaagccatttctcattttccctcgtctgtccccacttctgctttacctcactgaggagctactaacctaatttatatctctggacatttcacgtaaatggaatcatacaatatgtggccttctgtgtctggccacttagcatcatcttttcaagagtcatccatactgagcatgaatcttttctattttcttcagtacatgcctaggagtagaattacaaagtcttatgggaactgtgtatttaaccatttgagaaaccaacagcctgttttccatggcagtggcaccttgtcacattcccatcaacaatgtctggtgtgtgtgtgtgtggggcggcgggggggtcccgatttcttcacaccccgtcagcacttgtgatctgttggatggcagctatgggtgtgaagggcctctctgggtatgggtgtgacttccatttctctcatggctgaggcagagcatcttttcatgtgcttattggccatttctatattgtctttgataaaatgtctattcagatcctttgctcatttttaaactggattattcgtcattttttttcattgagttgtcagtgtcctttacatattctaaccacaagtcccttctcagatatatgaccttcaagtatttttttccattctgtgggtcatcattgatggtatccatttgtctattctttcttttgttgtttgtgctttttggttgttgattgtttgtttgtttgtttgttttgaaacagggtctctcagacccgatggctcacaaagacaccccataggctcacagaggagctggctaccaaattctgtcactcaggctggagtgcagtggccccattttggctcactgaaacctctgcctctgggctcaagcaatcctcccacctcagtatcctgagtaactgagattacaggcgcatgccaccatgccccatgcctagctaattcttgtattttttgtagagatgggatctcactatgttgtccaagctggtcttgaattcctgggctcaggcgatccgcccaccccagcatcccagggtcctggatgtataggtgtgagccatcacacccagcctgcttgtgcttttgatatataacaaggctttgcctaactcgaggtcacaaagatttactcctatattttcttctaagagttttacaattttagccattatatttagatctgtgctttgttttcatttttgagtatgatgtgaagaatgggttcttaatacttctgaagctgcaataattgatgtttggtggcagtacatgaagaaagagtgaagaatgtagatttattgtctttctcagtttggactacattttccaagaggtcatcctcaactcttgagttctttccatcttccctaaaatttttggctgttgagtattaaagtttctatggctttcaacagatcttaatccattgcttacatgtaatgcacaaggaattgtttagagtggtaacccctacataaccatgataaactatttgattcgttatatttcacatgatacaaaataatctgtactgccttgagttgtgttttacaggtgagcaagctattttgtataacagtgattataataatattgggggggaaacctaactcagtgtcattgctatgtgttccctgagtccttatctattaaatttggaaccaataaagtaaggaacatgctgaggcaaacttctaggaaaaaaatatctttgcccttgcaggagtatctagttgtgatgcagttgaggaacacagacctggcacaagctttgtccattacagagagcctctgtggcctcgactggtttctcaagtctgtaggaagtttgaacttttgctggagtttgactcaaaggcttgtgtatgctcttgttctgagatgttctgggcaagtacttcaaaatagatttctctaaattccccttttggtcagttatgtcagatggttcaggcaaccaagcttgagtcctcacttattttaccaaactaaccatgaaagttgatcaattcttccttcctaacagctctgtcaacagctcttactgcacctttgtacccagatcaagtctgcagtccgtggtcaccccttcacccctgtcctttctgtgtccccgaagcctaatcaagaggaagtatcactaagtctttgttgattatctttgttccaccatatttacacaacttcgcaatggtataaataggattcactcctccctctcagggtagaaattctaataaaagaatagtccattgaggctgggcgcagtgcttatgcctgtcatcccagcactttgggaggctgaggcgggcggatcacctgaggttgggagttcaagaccagactgaccaacatggagaaaccctgtctctactaaaaatacgaaattagctggccatggtggcatatgtctgtaatcccagctacttgggaggctgaggcaggagaattgcttgaacccagaaggcagaggtttcagtgagccgagatcacgccattgcactccagcctgggcaacaggagcgaaactccatctcaaaaaaaaaaaaaaaaaaaaagaatagtccaaggaaaaggcagcctttctccaggggcacagccttgcaggtgtggaggcgactgggttagcacttctccgaatggtgggtaagaagtgagatgaggtacggaattatctcaccagggttcaattcttggttttggtgtggatctttctgaaggacattggggtccacactgtggaattctttctcatctgaagtcagaaatctgtcacttcagtattcccctcttgtatcctaccctctgatctagtcttcccattaccctcgggcctcactcccaacacacatgtctttgaccttcactcccttgagttttctttcttccccatcaatctcacttctctctggggctcactttatcctctacccgatttgcatcccacagatggcgttattccctctggtccccactgctctggccaaaccttctctctgctgactgcatctattgctgtgagctgattgtcctctagtttctccatctcctgaggcatgcttcacaccactgccagaagagctgccaggcatgtgcccgggtgaagcaaagtggggagggggcttgaaatccagtcctcattccactgatcattttgggcttggtagagctgtgtctgcctagagagaataccttcctctaatcagcacaaagacaccctatgggctcacagaggagctggctaccaaattgacctttctaaaatagctgaccatctcattcctcttcataatacccttcagtgggtcctatcagctaaatgccaaactccttagcatggaatgcaagcaaacgctctaaggcctagcctgcttgtcccaccagcattttaatgagggtgatcatatgatttattgtccaaagtattcctttcagaatacttctgaaaggaaggaagagctgttactgattatgccagggcaatccactgcagtgcctgggcacttatttgtaacctaccattccacaccttggattcattcactgtggtagtaccaacccactggtagttttctatgtgcgccttgttatttcccgattaagaggttttgacagagtgattttgacaaccttgttgtgaatctgaggacattttgattcctttttctgattaaacattaaaagatgaaattcatgcatcctcaagtcaaaatcccaagtccaaaatgatcacagcctaaacaatgatattaaaacatctaatttacattattctatgctctggttacttgattgtagtctgaatactttgtctgcttagaacttgtattccttcttccccattttcctgcctttcctggcttatgtccacttattgttcaagatatctcaaggactttttcttccagttacctttccctgatatttcctggttgggctcagtgcccatcatcttgttcccacagcaacctgtatacgttttttagcatacctaaaaaaaaaaatgtgttgaagtcatgagttcaggcctgccttgcttacgagactattatgtcctcaaggcaggaagcctgtcttattaattgttttatcctcagtgctcagcacggctcttcacaaataacagaatcttaataaatattcctttacatagactaatttgatctccttgtaatatgaagtgaaacgtgcctgccccttatttcctggggaattttttagggtactagtgatgatttgtacctacctggagccttcaggacattgacttttggcatgttaaagttgtaaagcctattgttatttttttataccatagaatcatacacaaagaaaatacacgtgcataatattcacatatgttttgccaaaagtgtgaatagtgatgtgttaaacttgagtttttccataaacaaaattgtcctgagggtatggaagagtaattcctgtttaatgcaatgaaggatcatataatccattaaataatagtattccattcttgccttattttctttctttctttctttctttttttttttttttttttctttttttgaggtggagtcttgctctgtcgccaggctggagtacagtggcgtgatcttggctcactgcaaactccgcctcctgggatcaagctattctcctgccacagcctcccaagttgctgggactacaggtgtgcaccaccacacctgaccaatttttgtatttttagtagagatgggatttcaccatgttggccaggatggacttgatctcttgacctcatgatccgcccgccttggtctcccaaagtgctgatattgcaggtgtgagccactgcgctaggcctcttgccttattttctaagctctctggatctggcattttgagccaaggtgatcaatgttatcctaaagttacgtgtttgttttacaagcctaatgtctgtttccatttctctagaatgttttggacgtttaaagaatggttctggttggaaagattctggcttcctccaacaataaagtggtcagatcttgaggatcacgatggactcgtctttgtaaaaccttctcatttatacgtgacaattccatatgcttttctcttgctgattatcagacgtgtatttgaaaagtaagtagtacttgtgtctttccttcccattccccctctttgctctaacactagaataatacagtcttaggcttagtgagatccttaaagaatctgttgttcagaggttgccactaatgggccacagattctggggatgagttaatgtaatcagatgcgctccaaatgttatttaaaggctgaacaacaaaaaattagaaacatggatcccactgagtgctttagttttataacgaagaaaatcaagatcaagagaggttgcggaccacagagcttattggtatcaatgacaatacgggaacccagttcatctactcttccacggtgtctgacaatgcatgtgcattcccagaaaggctgtgctagaagagtctatgactcaggaagcattagcatcctcaagtgcctataaaataacaaaaatggctcattaaagtctaaaccaaatattgctatatagtatagcttattttaaaggtttatttaaaggtttaatagctgcccttcgttctaaagtgcaaggaaatcaaagagaaaaactatcagtttgctttctcagaaaaagtaaacttatttttttcttgatttaatttaaatggatattatttccagcctttttattaaaattgtactagtgttatgataacagtagataaatgttcatctataatctctgttgttgactctatttcaaaaagctgttattagcacattaatttatttggagcaaagagaatattcaaatgtcaagagttggaaaaacttgagacaaaatctgatagagatcattttgtccaagactaactgtaatgcagatcatatgtttataaacatttgcagggtccttatcttgagagctagtttgaccaactctgtttcatgaactcttgaaaaagtttttgtacaaacaacaacttcactggggccaacagcgtgctattcctattgggaggaaaagaaagcccctggaaaccactaaaccctggctgagagcatttgaaaatgtacttcttttctgacagttaattctactttttactcacgtatttggatatgtcaagaatgcataaataaagtagaagaattactatcctgaaatactaggtgtttttgcattgtatccggtgatctttgaatttggcatccaggtccattacttatttccattgcagatttcctactttttggtggacagctccatttttcacagtttggccaggactgtgagccagaaacatctttaggttgccaaagaagcacagctgtggaggaccagcttgttacgtccctgtcttggcctctccaacaacaatcaggaaggaatccaaccctctcttaattcctaggaccattgttgcttcttctcaagggattaagtatagtctatattctctattctatctccttataacttcagctcccaataactcactctcagccttttccattgtgacgctgcagaaaactatgtgttgcttcactaatgccatatctcttttaatgccatagaaggaaggaaaatttaacagggagagaggtcatactttttgaagtataagtttatgtttttttccagggcttctatatcattagtgggagattgaaccacttatatcataaataaaatatcacttataccttatatttgaataggagtttatagtttaagagctacataaaatcacaaatggtgtggtctcagtctgcaggtgtggaaatgagaggtaaatgacctggccaaggtcacacagttaacatgtaaggggatggatctgggactcgaacccatgagctcaggtttagggttgttggttttttattttctgactgtttcagtaattcttagactttcacagcgaaagactcctgatggcagaagagagtacacaaatgtctcttgggaatacagaaagcaagcttaaagagataacagcaaacataaaaatgtctgaactattttaaaaattcatgtaaatataaccctatgtttcagcatatcctgatatatttaacacaacaaagcttccttcttttgttctagactgcatttatgtacatcttctcattctatgaagtgaccaagagttgtgatttggctggttcattattgtcctttagtactagccaagaactatttaagatcagaaattaatgtttcttcctagaaaatcaagaagagagagacagacagatgagaaacaaagaagcagataatttgaaagtaactgacatttactttgtatttaagattttctttccttgaaagttatagtttgtgtcttatgttttgttttttgtttttgtgtgtgtgtgtggctaatgttttgatttttattttgtccagactactagtttctaattagtttatcttctgtgcattcttttatgtgtctgaagtgtgatttaaaagaaacctaacctgctcaaatgtcaacactcatggaataaacacattgtctcagagtaaatcatggtcccagaagagtccaaggcaggggtgcaggtggtaaaatcagaaggacacatttttattattgttgttacttaattatacacgagtagattctccaccccagcaacataaggtcatgatggggcagtatgtccatcgttctttaaagaagggtagggtagctggagtaacctatctgtagcgacttacataaattgaagaagtattgttactaactgtcccaaatggaaatagtcttaaaatatgcacattagactttttcatctgagatctactttgctcgcaatattttgttcacacataaaaacaaaaaacacaacaaagcaaaacctctggaaagctctgctcacagagcctctgaatccttaggaactgggaatcaatcttatgccaataggctagtgtatctatttaggagaagtatttaaatgtaacatgcctaatatctgcctagggatacattccttttattccattaaaatattaaaaataaagggagatatgggatgtctaggcttttggttcccaggtaactgatggggtgctagacaaagggggggccgtctgggtgtctgaatgggtttgtctgaaggctcagttctgcaatagtagcaaacctaagggactcattccctggtaattaacctaactttgaaccatttacatgggagcagatgttcattcttttttcttcctctcagactttttttttctattccatatcaataaaatgaaaatttaggcaagctagctggcaagctaatctctaagtttctttctagggctaagacttacaatttcccttatctcttcagttcaatttatcaactatttattgtgcttctttcttctctccttcttcaaaatagatttttaattaagtgactttatattcatctacactttattaggtgattgatttcctagatttatttgaaagggaaggatagcactcaattagacaactacatttatatctatactctgttctgttaacaatgttattttttggccgggcgcggtggctcatgcctgtaattccagcactttgggaggctgaggcaggcagatcacgagatcaggcgatcgagaccatcctggccaacatagtgaaaccccgtctgtactaaaaatacaaaaaaattaactgggtgtgttggcacatgcctgtagtcccagctcttcgtgaggctgaggcaggagaatcgcttgaacccaggaggcagaagttgcagtgagccgagatcacgccactgcactccagcctggcgacagagtgagactccatctcaaaaaaaaaaaaaaaagtgtgtgtgtgtgtgtgtgtgtgtgtgtgtgtgtgtgtgtgtgtaagagataggtatccagtaaaacaaaaatcattaagtctgtccttgaagttaacaaagaggactgtagttctctttcttgtttaaattaatgattttaacaggtatttattcctcatatcagcaaggatgctatgaatgtgtatatttatctatgtgtatacttacccatatgctatttctcacatgaccctctagagaagaatgttatgcttcatttggctttgagattagttttgtttccttactgtataaatctttggtttaattctattttgctttcccctcctaatttcttcatttctagcacttgaggagatagcactgagcagatatattgaaaacactaccctatgaaactatttccagtttgtgttgttctaatagagaaaaaaaatggatgttttctccactaaaattttccagctactaggttggataaatgaactaattcaattatttatccaaaaccctgtcatatatatatgtatttttctctctatatatatatatacatacacacacacacacacacacacacacacacatacatatatgctctctctctctgtgtgtgtctctctgtctctctctctatatatatgtctatataagagcaatcttgagtgatggatgactttttcattaattcctttttttccccatgcactactcccattcccctctctgtcgtgttctgtgtatttggtgatcctttatttgtatgacccagtaaaacatgtgcttcatgtacaggtatcacttgttgacacaaatggtattgcactaagaccttttctttcttcttttttaaaatttagcactatgttttatgatctctccacattgctctgtgtacatctggggcataactcacttatttttatatgtctctgaaatttaggggccattttcaagagaacttaattcatctggaagttggactgacatacatttaatcagattatcttaggagagtttttattcaacttccatcgatataaaaatgaatttaagaactaaatgatcattcataactaaaattgtcagcatttaattcaacacaaaaattcttcttaagtaagtcctagaattgactggactggcagaagatagtacctttgtcagaactgaaggaagaataaggaaatctcattattttaaaaatatctgctttattgaggtttgatttacatacaataaagttcatccaaaatttgatgcattttgacaaatgtatacagtcttgcaagcatcaccacgattatgatacagatttctgtcagctaaaaaattctcttgtaatgctttcagttaataccctcgctacccactagccaccagcaatcactaatctattttctgtcactataattttgtattttctaatatttcctttaagtgaaatcatatagattatggtcttttgtgttcgacttctttcattaagcttaatgcttttaagatttttttcatgttatgtatatcagtggttcctttctattgctgaatagtctttcaacatacatatatactataacttgtttatcctttagttgatgggaagaaatttgtgttgcatacagttttaggctgttatgaatgaagttactatgaacaatttgagtacaagaatttgtgcagatatatgcttttatttctcttggcaaagagctaaaacatttgctcttcaaggcactgttagtgtatatccctacaatagaatattgttctgcaatgaagaggaatgcactacaaatacatgccgtgacatgagtgagcctcagaaacattcagctctgtgaaagaagccagacacaagtgaccacatattgtataatttcatgtatattaaatattcaaaaaggcaaactagaaaaacagaaaatagatgagtggttgcctggggcaggtgcaagaagaaacagagattaacaatagacatgaatgatggaaatgttctaaggctgattcatagtaatggttgtacaacttagtaaatgtactaagaagtcattttatatattaaaaattgtatacttgaaaatattgaattatatgatatgcaaaataccttactagttatctttttaggaaacattactgtaaataaaataaaaaggcaagccacagactgggagaaattatatgtaaaacatatatctgataaaggacttaaattcagaatatataaataactcagaactcaataataaaaagaaataacttggttttaaaaataggcaaaagatttgagcaaatacttcatcaaataagatatacaaatagaaaacaagcacatggaaagatgctcaacattattagtcattaggaaaatataaattaaaaccacaatgcactggattagcaaaaatgtcagagtaagaacctctgaaaattctttcttccataaaagcaaccagaaaactagcaaaaattgtcacagtcagtttttttcagaattgagaatcagccaaaggcttacagggatgtaggagttgttatttaagaaaaacagcagattcttggaaggaatagcaagctgtgtgacatttttaacttgccctgttcccatcttgccctctccatctctggatagccttgaagaaccaatggcccacaattacagtggaaactagcaacctggctgccactgaaaggagcagaacagagtagaagctccttcaaagctcattatcaggggactgtcactatctgacctgtctgatggttctctggaaggcactactcacaatgctgtctttatctgacctgactcagcgctcacccagtgaaaaagccttttccctgagggtgtttgtctaaaacaattagaggcacttgattaacttcataactgtctaagacagtggataacaattagggcaaacaataaaatgaccaaaaagctttaaaggaaaacctagaacatgagatgtgcattgaaggctttgaaaaactccaacatgttcttggaaatctagaagacctgtgtaagggttaatgcatgttcatggctatctgcatgctcaggaaagacctgggaaggccataagctctcacctctgaatgacctttaggctctgtgcaaacattaagtgaaggctaaggcagagttgcttactgcctagctaaatgttgaaggtgtgctccaacatatgcacagagctcctcaggaaagactgagagacttactggttctaagcatttaaggaaatctctgtctaatcattagctgaccactaagctaacctaataaagccttcagtgctcacacatcacaaagaagactttacagattaattcaaaaaaggtgactaagcctcacgtctgtaatcccagcactttgggaggccaaggcgggtggatcatgaggtcaggagatcgagaccatcctggctaacatggtgaaaccccatctctactaaaaataaaaaaaattagctgggcgtggtggtaggcacctgtagtcccagctactcaggaggctgaggcaggagaatggcatgaacctgggaggtggagcttgcagtgagctgagatcatgccactgcactccagcctgggcgacagtgcaagactccatctcaaaacaaatatatatatatatatatatatatatatatatatatatatatatatatgaaaagaaaaaaggtgactaagcaaacaaatggacaatgacaaatagcaaaaacaacaaactttggggaggagaaataatctgatttttatagttgccaccttatagtatttaacatgtccaattttcaacaaaaacttatgagacatggaaagaaacaaaaaattatgcactatacacaggaaatatagcaattattgcaagtgtttctgagaaagcctagatagtggacttattagaggctttaagtcaactattttaaatatgttcaaagaactggagaaaaacatgcttaagatctaaaggaaagcatgaaaacagtgtctcaccaaatcaagaacatcaataaagtaattgaaactataaattataacaaagaaccaaatagaagttctagggttgaaaactacaatgactgaaatcaaaatttcatgagagaggctcaatagcatatttgagcaggcataagaaagagtcagcagtgtgaggaacagcaaaataaaagagaatgaagaaaaatagtcttagagacttgaataccaacatacacataatgggaattccagaaggagagaagagaataaataggaccccaaaaatgtgaagaaataaatggccgaaaatttccctgaattctgaatctgcatatccaaaaagctaaacaaactcccagtatgatacatttaaagagaactacatctacatatgtcataatcaacttgtcaaaagccaaaaagaaagaatcttgaaggcagcaagagtggaacaactcatcacatacaaggaattctcattatgattaggaatcgatttctcatcagcatctatgtaggccaaaggcggcggaatgacacataaaaagtgctgaaagaaaaacactgtgaaccaaacaaaactctccttcaaaatgaaagagaaattaagacattctcaaataaacaaaaaccaagagaattcattactagtgggcctagcatacaaaaagtttgaaaggaagtccttcagactgaaatgagagtacacaagatagtaactcaaatccacatgaagaaatagcaccagtaaaagtaactacataagaaaataaaatgatagtataagcatattttttgtttttaacactttctcctatctgatttaaaaggcaattgtataaaacaataatctaaatctgtgttgatcagaacacaatttataaagatgtaatttgtgagacaagagcacaaagaaggggacggggaatggagttttttaaccctattgaaattaatttgatattaatctgaagtaagatgttataaattaatatgtcaattataatccccaagtgaatcactaagcaaataacttttaaaatagtaaaaaaccaaaaagacaagaaaattaaaatggtccatcagaaaatatctatttaacacaaaataaggtagtgatggacaaataaacaaaagggcataagatgtatagaaaacaaatagcaaaatggcagacataaatcctattttatcaggaattactttaaatgtaaatggattaaataattaaaggcatagataaaatagttaggaaaacacgatccaactatatgttgtccacaaaagacacctgtttgtttaaagacacaaataggttgaatgtaaaaggatggaaaaagatataccatgcaaacagtaactaaaagaggactggagtagctgtactaatatcagacaaaatgtaatttaatagatttcagaattgttactgcagacaaaggacattttataataataaaagggtaaatctgtccagatgatataacaattgtaaacatatacacacttagcaacagagttccaaaatacgtggagtaaaaactgacagaattaaagggcaatcaggcaagtcaacaataatagttgtaaacttcaatactcactttcaataattgatagaacagctaggcagaagattatcaacagggaaatagaagacttgaacaatattgtaaaccagctagtcgtaacaaacatctatagaacactctactcaacaacaccagaatacacattcttctcacatgcacaaaaaacattctccagcatgattacatattaggctacaaaacaagtctcaataaatgtgaaaggatttagatagaaagtatgttttccaaccacaatgaaataaaattagaaatcaataacagccaggcacagtggctcatgtctgtaatcccaacacttcgggtggctgagacaggaggatcacttaagactaggagttggagaccagcctgggcaacatagcaaaaccctcatctcttaaaaaaaaaaaaagaaatcaataacagaaagaaatcaagaaattaacaaatacatgtaaattagataacatatttctaaataaccaaccagtcagggaagaaatcacaaggtaaatttgcaaatacttgagatgaatgaaaaagaaaatgccatactaaaacttaatagaatacagcaatagcagtgtttgaagggaaacttacagctgcaaacacctatatttaaaatgaagaaagacctcaaatcaataatgtaaagttccaccttaacggactagaaaaataaaatcaatctaaatttaaagcaagtagaagataggaaataataaagattatagtggaaaatcaacaaaaaccactacacacccagtagaattgccaaggctgacagtaccatgtgttggcagggatatgggctaactggaactctgacaaattattggtgggaatgcaatatagtacagtcactttggaaaacaacttgccagttttttataaagttaaatgtataattgccctaccacccgtcaatcctattattacgtatttgccctagagttgtgccattttttcgtatgttagaacttgaaatgggaatgtagtaatttctttaagataataacaccaaataaaacattttctaacaaaattcctatttattttaatccccgggagtctttaaaattctaagtagaacagcttattctaattcctaaatcttatctataaatatgtttggattaacataaaatgcattttagaattgtgcaagtgttttttttttaatcattgcttttttgtatggactgaaacttttctgttttgagagacagattttggctgtacgtagccccagtgtcaacataaacaaatgactgatttcattagaaacctgaagttacagctttaattttctggtgtcatcgtggatttattcttagattttgaactttttttcttttcatatttttgtagatttgttgcttcacctctagcaaaatcatttggcattaaagagacagttcgaaaggttacaccaaatactgtcttagagaattttttcaaacattccacaaggcaaccattgcaagtaagtacaaattctttgcttttcgacttaaaaatcttctttcttaatggttcaattatctatagcttaccttgtgtgtgcaagaaatctattctagttgaccagcaaatgatctggattcacttggatttattgtttctttgttctgttgacaggtttagaacatcccaagtgtgatacatatgataatataaaataacaaatattaacagttgaactattgtatttaactatagtgtagagcactaatgatcagtgccataatttgggaataaaggtcaacatttaatttttaatggtcaaatatatacaaagtatacagatgaagaaatataattgttagggcagagaagcccatatctgacaattttgatgattgtggcatcatcaaaatacattacacacattatgaaaatgttcattggggtcgctttcatgagtaggactgttattttattcaaagcctcaacatactcagaaatatgctgtgccccgactattctccagagacaatttctaagagtcacagttctcttcacaatataaagtttccttcatttatgttgtagtgcactgcatgcttaaatacattcagaaaaagaaaaaagaaaaagtttttaatctaatagttaaaaaaataatgtctaagtaagtctagtgttcactccagttttgttatatttccacagttaaaatgacagatgaaacaaaacttctccaaaagtgatacaacctctatgatgaatacaaacagctatccccagtaattttaaaaatcaagtacatatgctaacacagttctaggataaatagatttctgagggtcctgaactttatttcctgaattaagttgcctctactatgacaattgctctaatttgttcctcgtggtttctctgcacatgaaagcacattgaggtttgaccacctcgcgtgagatatggtgtccagaattgctcatagcaagtgagagctggctctaacttgttctgccctcagctcctgtatttgactgcttttgtaacctaggaatagtctgacaagccatctttatatgttttttattcccatgtgctttaaatgactgccatcattcatctaaatccttttgttaccactggtgataataatacctaagcatccctttatatgtttcaaatgggaaattatttagctgtgtttaaaaaaagatagggctctttctgggtcctttattatccttctttgtttgggaacaactaactttagtaatactttgtataaaatgggaagaacagtgctataataccaattcgttgctatccttgctattgctaagagcttctagtcagcttttcagaatatttaaaattatctagaaaatttggtccttaccaagcttctctgctatggagaaaaaatggccaaaggaaaactaaggatagctgaaaaggtttatagggtggtagtctttctttttcatgattaagatgaggaaacttaaggcccagccaaaggaaaatgagtggtcgttcggctaatgagtggctgaatcaaaagctagaacctggcccatacttccagtccagtgacctttccaccatgctacagtgagttctttatctgtaaatggaatgttaaaaatatattttaaagactggtgctgtgtttatagtaattattctaactcaactgacattacagtatggtttaataaagacagaattttgacatttgcatccagtaagaaggaaaaaaaaagtggctgggcgcagtggcttacgcctgtaatcccagcactttgggagcccaaggtgggtggatcacgaggtctggagatcgagaccatcctggccaacatggtgaaaccctgtctctactaaaaatacaaaaattagctgggcgtggtggcgagtgcctgtaatcccagctacttgggaggctgaggcaggaggacagcttgaaccagggagttggaggttgcagtgagccaagattgcgccaccacagtccagcctggtgacagagtgagactccatctaaaaaaaaaaaaaacagttatatatcacccccgaagtgttagcttcatctattgaaccaaaaaggtgaaggaatataagattcctaaattatattgctctgagattaaaaaactgaggcagtattcgtatagtatatcaagataacaataatttggccagcaaaatgtccatagcctaaaagcactaggacttaggaagatagaatgtaatacaggaggacagagttcatgacttaatagcaattgcagatacagaaacaaactcgtctcaccatacctaccacattaacctggccagtgtcatgcagatagcactttgcttaattatggctgaggtaataagacaagttgctgggtggatgaaaaacagttttgtactgattcaagattagggtattaccactaaaaaaaagtattcaaaacctaaacagtagaatattgcattggtaatatttgtagataacacctgacttgattgaaacaatggagtacacagacccaaggatgcttcttcagcagctataggctgcaccaggaaaacaaaacacttccatgcatatgacatctactgtgggctggttagcacagaagggcataacatggtattgatgaggcctaaaatactatacacatgagcctcagtgagagttttggtctgtgatattgcacagttctcttatgattgtatctatgcaggtgtgtgtctgataacgtgtgtatgtgtgcgtatcaagaacaacttccagatgtttggggtaagaccaacaactctgaccaacagatcaattatagtgctataggtaacgtgtagtaacagtggaacttattatctagccctttccttagcaaaataaaaaataattatatatatatgaactgatgcagagcaagtaagttctggaagagatctgaagaaaacgtggcactgtgagactgaactcaagccagttactacattcaataaaggtattccagtgtgctagcttgagtcattcatagattcaaacatttttagagcaaaaacctcttctagtgctatttattgtacagggaagacatgtgagagccaaagaggtagggtgactcctctactggcacagagggttcccttttcagtccagaggccaggtctcttggccccattcagcactcctcctttaggccattcgacctctccttgaggctgtgtctgagagagacctttcctgcatgttccaacccacttctgaatgttcacagcaataggtagtgtagaggctaaaaatacaaattgtgaggacagaccatgtaaggttagagcctggctctgtcaccgactttctgtgtggagatggacagattaaacttcccatgcctcagtttcctcttctgtgaattgagcataattatattgcttatctcatagggctcttgtgaggatcaaattgagttaatacatataaagtgcttagaatagtgcttggcacatagtagatgctcagtaaaggtcagctattattatttgtaccattaactttgtgcctgtcatgcactgacttccaaaggagcgtgtttaagcatgtcttcctcactcaagggaattgtcactttgtttcttaatcatgcttgtttttgttcccatgacatcttgcactattttctggtcattacagatggtcaataaatgcttcatgtttcacacattaattcaagaaaacacttttagacacttttgtttgcaaggagttttctctcttaataatatcatagtgcatgaggccagtattgacaagactgacttccaactagattcttctgtactccaaaatagaaaaaaaaagcttcgactcataaacagttactgtcttctatatatgtttattaataattcattgggcaattatttgcagaagtcatgggagaataaaattgagttgttctaaggtctgagaatattccagaataaagacaaggactttagtttgttttgctcactactgaatctcccacacctagatggtgcctggcaccagtgcttagagactctttaaatcctttcaaatgaatgaatggcaaaacacttgaaatagtaaagctaggcccagagccccttcggtctgagcacacagagtgtagtgcagcagcatgccagaatatgtcctgctgtgcaccagccaacagaatttgaattgtattctccatgttgggggtctgttcgtgtttgcaaattatgttaaaagtaaaggaatacttttttcttaaatgatttgtagtccatggtttcctttctgtgtttggtcatcaaaatctctagcactgacacggcactcagtagtttcattagcacattctaatcccttggtcctcaaatcatccctcggaggtgggtagcaaacattctcttaatatcccattttccatgggggtcaaagtgcggtgcttacgcctacatagctaggaggtagcagaactggatcttctgttttcagcttcctgcccttcctaccatatccgattgctttgacactgcagtgttctttccttcctgcaagggaacatgtaagataatctagcagaagctatccggctggtcacagacttttgggtattcagccatctggcccacaggcaggctttatttggccctcacaatactcatccacaattggtttaaatttactttgagggattggtcaacatttttaaaaacctagtgatttctcatcaaaatcctgggtctgcacgttttctctggaagcgtccgccagatcttggtcatgcctggccttttgggacatgatgtgtgcttctctgcctgctgtatccatacggctcccacttctttcctcagcactgaagctgaaggtcagttttatgccattttatttttcacaaaatagaattaagaggaaatggaaatgtttcttttatttatttatgtatttatttatttagagatggagtccttctctgtcgcccaggctggagtacagtgtcacaatcttggttcactgcaacctctgcccccaagattccagcaagtctcctgcctcagcctcctgagtagctgggatcacaggagcccaccaccacgcccagctaatttttgtatttttagtagagatggggtttcaccatattggccaggcagatctcgaactcctgaccgccttctcggcctcccaaagtgctgggattacaggcgtgaaccaccacacccagccagaaatatttcttattcttacttgggaaataagaaatcaagagggctggcattttttatgagcatatttctttgtagacgtggagaaggttaccataggtttaaagtacaaaacttgcctatgttaaaatcccactgtgaaacagacctggtccatttggtcatttatgtttcttgtctggcttggggagaccttcgaattggtaacatttgagcagatctatcattcatattgtttccaattttaaatcatagcctacaacttctacttcccaaaagagaagcaatcatcatcatcatattttgcaattgttatttttgttattgaaattattttggattagtttgaaataggctctctatataattaaatgtaaaagtggatggctaacactggttggagtttttcctgcattatcttctggagctgtgagaaagatcatgtgaaataacaaaatgcactagcctaagttctcgtccacactttgcttctaattttaggttttggacaagtcactgaacttcttggggcttcagttccccataggaaaaatgaggagattggattttattggatttgatttaaactatgctactctacctggcgcctgggaagtcctaagcacattttagctgaacaagtgagctcacacatgcaacttgaatgccgggttgctgccagcgtatggagaattgatctttctcagtaacttagagagctgggatagtaacattttgttttttggtatgtgtgcatatatgtgattccataagcaaaagaggtaaattccctggctccaggtctcatgacagaatttctctcatccccagtaccgaagctcttgtaactcaatctccgtctcttgtctgcctgccagtctgactctgttctttatcactcatttatgcgtttcatcccttttcagactgatatttatggactggcaaagaagtgtaacttgacggagcgccaggtggaaagatggtttaggagtcggcggaatcaagagaggccttccaggctgaagaaattccaggaagcttggtaaggaggatgggccaagctttaggaatgctgccgtcctatctggagctgagtggtccttgcagagagaatactgccggagcagcagagggagggttcagacccagctctgtcacccactgatgtggtgttttaggctcctcacatatttgccttctctgcttcctccactcctttataaatcaagtaagctctgaactctatttatcgggcctcccgaaccagaatagattcagacagactcccacactatgaactctctaagatgaacaggagatgttatgtactcagcctgaaacccagaaaaaatcataaaaatgtcttaactggtgtttctcttttcttagggtcagggttggccctaagtcaccagactttatcacctgtatccaaccatcacaactgtaagagcagagaatgtctgcaaggacgtgtgttccctctcagaacactgagaaggcctctctgtgtggcgtggctcatgaccccagccctcctgtagggtgcacagcccatcctcttggtttcccaggatttttagtagaggtggtcaggagatcaagaccatggtgagaccccatctctactaaaaatacaaaaaattagctgggcgtggtggcgggcgcctgtagtcccagctactcgggaggctgaggcaggagaatggcgtgaacctgggaggcggagcttgcagtgagccgagatcccgccactgcactccagcctgggtgacagagcaagactctgtctcaaaaaaaaaaataataataataattattattattattgatccttctgccaatgatgtgagacagtcagggaagttggggctatcctgtttcaatgagaaactgcacatccatctagtttaagggtctcttaggtgtttgaatggctgttgcattcagatcttctgactcctattccgatactatttcttgttgtatcatactgcccctggcacctaatgcttacctcccagcaagcagaggatccttaaattgagtaatatttgggcatctggccatgtcagtaagcctactaaaattcttccagagttcaggctggagaagggaattttgagttacccttatcaatcagtcaggcaatgcagaggtacaggttagtatcttttctgtgcatagcactgtcctagattttgtggcgttctagattttaagaagggggtaacatgtgagtcgtggttaccggccttaaacagtgaattagggaggccagattatcacacacgaaaccacaacatctattgtcgcgccaccccagtggcacatgggagtgtacaccagcagatacaacatcatgtttagatgtgtcgtgggaatttagaggtgatggcatcagcatggctgaagtagttaaagaaaggctttctagagaagggaagacataggttggaccttgaagaatgggtcaggttgccaaaagaaaagaaagcaggtttgaggcagtattttcaagtaaagcaaagacacaaagcaggaaattatgcaatatattcaggacacagtaagtgggcccatgaataaaatttaagccttatcttattctttagcaatgtcacatgtttattctaagttaaaagttattatggactagataaacagactaaacctagtgccatgttgaattgtacagggactctgctttttaaaaatcagctgtgggatgtgctacagaaatcacagcatgagttacctaacctcaagccttttgaaaatctccgggcgcttatttcttaaccccagctcctaaaattactttccaacaggcaaaaattcctttgtaacatccagagggatgagcccccaggcacgttgggttcagtgtgtttgttccttggtgactttctctcatggtgacccttgtgctctattccacagcattcaggattttaatacataatgggcccttttttttaaaaaaaaaaaatcaaattccacattagctgaccactttttcattttaaaatacagatttccacctagcaataagaaggaacaccaagtccttaggtatccaggtaggagaactcctcagtgttggagaaagggctctccccggctgggtggatgcggccttaccctcatctgatccatgcagtccacggcccactctatgcagcgtccccaccacaggcctcccatctggccccagcagtgtctctcaccactctgcccattcctccctggctgcaccctgcagtccctcctttcactatcaccattgttacccaaccaattcgtttctgaatggcttttcagtgggttttctctccccccacgtttatgtttatctcattctttcctggaaaaaaataaaagaagttttactcttaggtgaaactagtgaaatgacattgacaaggatattatcattcatcttttcagtgaagtgcagcaattctccaactttttggtgtcaagaccccttggtctctgaaaaactcttggaaatgccaaagagcatttgtgtgtgttatacctattggtatttactgtattcgaagtgaaaactgagatatttataaaacaggagactacacaagcgcacgtttcatcagtgcaatttcattcagagcaatactgtgatcacatgtcacatgacctcgcttgtgagagaatgacaggaaaaaaagcaaataatgtgttagtaatattctgaaaatattctgacctcagggttctctggcacacactttgagaatccctggtttagggcttctctgagtaggatttgtccagaaacatgtgagacttggctgtactcttggatctgagtattactcctcaaacttccgtaagttttatgatctttcttagcttcaatttcctttaggatattggctgttagcaacagtctgtaagaagggactaattacagcatcggcttcataatcttgtgaaaagaaaaatgtgacatagcgcatgtgtgcgcagcaccgtgcccgatggagctgagaaatcaatagatgcttgggaaataaacaccgggggagcacccacacttttggcttcatttgtgggttggctggccttatcatctcctatattttgtgggttttgtttggacaagataatccagggagccaaggaaatgctcttagcaaatcaaatgagtgcagtaaagtttcaactttcattttgtaaaatgtcttttggatatttttatggttcaactttttgactattgaaccctacttttttctcctatcaaaacaagccatgaagaaagactgtcgtctagcttaggggaaatgataatgttcaggaaacactcctcgatgcagagtccaaagagctgcacttcaaggtgcagctttcctccttcttagctacatgagctggggagatggcttcatttttctgattctgattctacatttacaaaatgggtatttatctacattcctatgtcctatcttacaggtgtgtcaaggaaagcactgtaaggccttacacaaagataagaaaacatcttattttaatattattatttctccagcaatcattagataaaatagacataactttaaaaaactttttatttggaacgttgcaagcatatattaaagtagaaagactgcataatgaattaagtgttattacccatcaccagctttagttgatcaactcaaggccaatcctatgtcctctctatccccactacacctctcgcctaccacagataggtttggaagcaaatatcagacactgttatttcatttgtaagtattttagcatgtatctcgaaaagataagaactctttattttcagcataattgcaatatcagtatcttatgattttttatttaataaaagatttttacttaataatagaaaatattcagtgtttagatttccctgattgtctcataattttctttacaatttcttgatttgaatcaggatctaaataagatccatttgttacaattttttgatgtgtctttccagtctcttagtctacaggtttttctccatacatgaggaaaatcttctctttcaaaacctacttttaggagaaaagagtaaagtctggccacataaaaaccttttaactgggaattaaatggggataagagaaataattaaacttattaggttccttcctgataatgctaatatcaatccactgtttattgtgtgcctggaactgggctagccattataaccagaataatggctgccatttattgttgcttactttatgctagacctgttatcacagattttcagttcttttcacattttgaggtagtgttcttattctcattttacaggtaagaaagtcaggccttctgaggttacatgatttacctaaggttgtaaccatctaataagtggggcagagccaggatagaaactttgatttgtctgactccagaatgtgtgttctttgtaaaatctgccatacctaatcattttctcctcaaatctcagttacctttacaagggagtaaagatttttctttcttttggcagctggagatttgcattttacttaatgatcactgttgctggaattgcgtttctttatgatgtaagttatctttttatatcttcgattggaatttgtctttaatttttgaaattcttgtctgtgaattcctttagggtatagtactttcaataagataaccagttttagagatttctctcaagattcaacatttgtctcaaatattgctacagatgtctcaagatttttttattgctgcagaagcaataatacaattggtttagaaataatttggttcatacagttacttgtttgaaaccatttcctctatgagacagcactatttacttatcttagattcactagtagtgaatttcacagagatgttatataggaatatgtaagaaatagtctacagagggagaaatacgtgcaatagaagcaaaagaatatggcaaaggtcaatttcctgtgcatctttgcctgctgtaaatgacataaggaagagcttaggttttctgccaaaattgacctttgacaccgaccaatttatttctcatctgttggctctttttttttttcttctttcagaaaccttggctatatgacttatgggaggtttggaatggctatcccaaacaggtaagtccactataacatattcctccccttacttgaacaccaagatccctcaaattatctccttagttacgtcttggtcccctgctactctttgttcactactgtgtcatccctggcactttttctacttgagcttccttatccttattgaccctcatttgtctcattcctttagtttgtttacagttaatgtaattacatatttgggtttaaatctaccatcttactatttattttttacttgtaccacctgatgcattttcttttgtactcccttcttgcttttctatgggacagtcaagtaattaaaaaaaatactattctttttcatcccttatattgacttttcagttacacatgcttttgttcttctagtaattatcttggacattactgtatatgtccttgacttattgcagtctgatacaaatcggtgttcttacctctttccactcactgaaaggtaattagaatacaccatacaccctcctccttcaaatatttaaaaccttagaagtcattgctattattgttctgtaaatcggtcaagttaccctttttgtgctattccttgcttcctatatttccatgtttccatctgggattattatcctcctgtctgaagaagtacctttgctattttttttaatggtgggtatgccagattttgtttgtcagaaagatgttatactgcctttgacttttaaaggatatttttgctgggtatagaattctagattagcagtttattttccttcactttaaatgatgttatttcattgtcttctagatctcatcagttctaaaagaatgtagctgtcacttttagttttgcttctttgaacataatgccttttttctctttttggctgttcccctcataacacaacccatgatgtgtgcagttatcatctgacctttagccctatggggattagggatggaaggattggcccaaatactgatactctggctactgctattactgtgagtcataaactacatgctgtctaccaaggtgtctactatcttctaccagcattcatggaacttgtggctaactaacttgttagcttgcaactagggtaaaatgtcagacacttcactattctggatattttctactttcctgttgtccagttcactggtacttttcttaagccatgtctaatctactattaaacacatcttttgaattctcaatttcagttattatattttttgattctcaaatttttattttattttttaatggatcccagttctctactgaaattttctcttttaagctgtttttgaagttattttaaagtcaaagtctgattagtctcatctcttgaccacctgtggatctgttttctctcttgctcctgtctccttatgcttcatagcttttgattaaatgacagacactgtatacaaaaaagtatagatggtcaggatgatattatcttccttcacagaggacttactttcacttctgttaggtgttagaatagggcagatcacctttaatccttgattgagctgattcaaggtagacttcagtctttgtgaaggcaagtatattcacaacttacccatattctagggtattccttttcaatgatttcaaataaaatattacagtgcttaccatgactccttttccttagtcaacctgaacaccagtttgcttcctagtactctgatattacagtcactactgcttaacttctgctgtttcttagtctctgggctccatactgcttataaactggcatatgcagaatttatgatatgtataggatggtcttctttgaatttattcttagggcctacagtacttctcaagaaacagggttcacttgaaataaaaggttcgctctagtgcatttttcttctctttaggatcttgactccacaggttctggatgccctacttgctctctgacgtcttcaaacagacattctttcttgtcctttatccagatttttaagttgttcttaataggaggattagtctcatatagtcctgtcatagaagaaagcagaaactctgtctcactcttttatggccttatcaaggatgaggagttgaccaaaaaaattcgttatacgttagcctcagcattaaagaattcaataaaattagacaataagggacctaagaattagctagaccaaaccccaggcctatcatcttctgtctccaacttactcatatcttctcaggtgtatcagttatccgttggtacataacaaaccatccccaaaacttagtgccttcaaacaacaaccatttattttctcttgatttgattgtcaatttaggctaggctcagctaggcagtgtttctgctccatgtggtgtcaactgagttcattcatgcattttcagacaattgggaggccggctagggaatggctcaagtctatggtgacgtcattcatagcattggcgatcagcaccttgattctcttctttgtggcctcttcagcaggatggctcaggtttcttacatggtacttataaagtctctgcatgcatcacatttgcttatgtctccttgaccaaagaccaggatcaagtccatagtcagtgttggaggagactgcacaagggcttagatatcagaaggcaacattcattgggtacactaagtaatataatgtctcaacttagctaaaataaacaccaccactcccactataaaattgttaagaaaattctagctatgaaaattttattattttattcagaagatatttttggagttcttaaataattatgcatattttattactgtcccattttagaatgggctaattctgaccaccagcctgtcaccagaaaagagattaagacatcagattttgagtaatattcaagaaacattaatcaaagtaaattgtaggaccagcagaaaagacttcccattgttcctaagtaaagatttttaatttttttaaaaatttaaacttgactctgaataaactgaaggcatttacacctgtggcagttgtatttaattttttaaacaaaacattcaacttgggtttggaatacttgtctctacccttttagaaataaaatgccttaaaatattatctttaattccttcgttgaaatataaattgaaatatcagtcaatgttattttatggaatctggtgggatataaataggtataaaaggaggttttagtgcattaaaatgagttgcttctatgatggcatttaaagtaatgaatactcttcttttcctcagcccctgctgccatcccagtactggtactacattttagaaatgagtttttattggtctctgttatttagacttggctttgatgtcaagagaaaggtaagtgtcttatttacaaagcttctttatcaatttcttcaaaaattgccatctccctgccccaaattctaatctttaagttgtatttttctgtgtttttgggtccagttcattgcttttgtgtgctttatagtacataaaatattgctaattatactcatgctttggtgccttggtaaacatttgtagtgaaacattataaaaactttaactttgaagctccacctctgttcaataagaaaaaaaacatttcctttatatgtctgtttcttgggaacttaatgtccatcagtgcaaagaagaaatatgttagtagtattaattctacaaccacatcttttagttgattgcaaaaccacttcatatacaactttttgatattttcaaagacgttgaaaacatttttccattaattcatcaaatatatttatgaggaaaccttgcttcgggcattattagctttgctttatgtgcagggaaactcagtcacaggcatgctaaatgccacttctgaagtcacaaagtgaggtattttaggaatggtttggttgttactgattcctaattactaatccagcaaaccatgttaaatcctgaatgcaatcataagattttgtcgtatatgtaagcaattcagatcaaatgataaattctcttggcatatacctcataaactacaccgtaaataaaaggctggtttgtagcaaaatttgtatggtaaatacaatgacatttaatattagataaaccagtttagcttgattaaatgtttgtgttgagtgatggtggccattataagggacacactgcagtcaactggacatcttaagacatgagaaatctaagtataagcacatactgtgaaagtatctgatagaaataatctccatttccatgtaactcaatgatagctgtagattaactatactaactttaggctaggaatacatcaaaatttaattggttgagtcattttttccagggatagaattgaaaataatcattttttagaaagtctttatatacaggtaggtcgatcatgtatttcacccacctttgattttgccgtagttgacttcccttttatcatttacgggtgcattgaacaccttcttaaaaattaaatataaatatatgttaaatgtcttataaagatgtatcttcagaaacataaagctattgggaggtggctaaagcacaggccctggagtcaggtctcctgggtttgaattcctggcttcaccacgcactaacatcttgagctagttagttaaactctctaaacttgatctccttatctataaaatgaagctaaaaatagttcctatctcctctgtttgttgtgggaattaaacaggttaatctgtataaaatacttcctgaggctgggcgcagaggctcacgcctgtgatcccagcactttgggaggctgaggcaggtggatcatgaggtcaagagatcgaggccatcctggccaacatggtgaaatcctgtctcttctaaaaatacaaaaattagccaggtgtggtggcacatgcctgtagtcccagctacttgggaggctgaggcaggagaatcgcttgaacctgagaggtggaggttgcagtgagccaagatcgcaccactgcactgcagcctggtgacagagcaagactccgtctcaaaaaaaaaagaaaaaaaagaaacttcctgatatacagcaagtgctcaataaattgagctattattggtattgtatttactttggctatgaggaagctgaaatctttaagttttttaaacatctttattgagatatccacatataacacaattaaaccatttaaagtatacattcagtagtttttaacatatattcagagttgtgcaatcatcatcacagtcaattttagaacatttgtgtcatcccaagaagaaactctataccatttagcagtcactcctcgtttctctcaacctccccagcccctggcaaccataaatctcctttgtctctatagatgtgcctcttctggatattttatataagtggaattatataatacctggtcttttatgtttgtcttgtttcacttactgtaatgttttccaggttcatccatgttatggcatgtatcagtacatcattactttttattgctaagtaatagtccattgtacggatggatgcattttattcatcctcttatcagttgatggacatttgggttgtttcctccatttggctgttatgagtaatgctgtggattcatacacaagtttttgcatgaacatatgttttcattccacctaagagtggaattgctgggccatatggtaattctatgtctaatcttttgagaaactgtcagactgtttaacaaagcagctacaccattttgcatccctaccagcactgtattagagttccagtttctccacatccttgccaacacttgttattgttcatcttttttattatagccatcctagtgggtgtgaagtatatctcattgtggttttggtttgtattctcccaatggctaatgattgagcatgctttcatgtgtgaattggccatttgtatattttctttgcagaaaacctttaagtctttattatactcagtgacagtagctttccttaggctagattgtcttatttcatatgcactaacttatttaatggttgtgtagatttattatatcaatcttttttttctttttggggaataggcaggggctaaacaataactgtaggtgtacacaggaatatgcttgtgtgtgtatgcatttattgtgtgttggggggcagtgtgtgtgtacacatatatccagtgtgggatggtatctcaacgttaaatgatttcatcaacaagaataatacatgtcttagctccctcacaaagattgtgtttaggaagtaaaagcattttataaatttcaaaacatgcagatgtaagttattggtctcattattattatgattatctcttccagtgattgggaaataaatgcatttccttaatggcttccattttccctcatcttacaggattttctagctcatatcatccaccacctggctgctattagtctgatgagcttctcttggtgtgctaattatattcgcagtgggaccctcgtgatgattgtacacgatgtggctgacatttggctggaggtaaacgtttgccattaaaaaactaatgacaataccatgtcctgggtttccgtaactgctcacagaagtaattgtgagcaatttagcagagctctgtgtcctgaaaacacccaaattctgagaatatctctagattcccagatcctccaagattacagaaatgaaacctcttagttttaactttgaatccttctccatggtactagagagatgttaatttgtgggattccactcctgaaggttgcatgcacatgcccactcaggaagtaagatgggatatttgaagaaggaatggactctaatcttctaaaaggaaaacttggatttatgacattgaggattcccaaatttggatggcaccatctattcacttaggccaatgcttgaatacccgttgaatgttcacactcccccaccctcccctccccgagcccaatcccttgctttaaggagtgtaagatgattttttttaaggccctcattttctaagggaggaagagggcttagaatgttttctgaaggagtcaacattaaaacaagagtcttcctaatctcaccccacacaaaatagaagaaacaaagccacgttgggattgttttccggacctgtttctgttctattttgattcttgttgaccccaggcagtgatggaattgtccccttctctgccagatctcttgctgtatttagagcaacagttcccagaactgctgagttatttgtttaaatatactcatttataatgaatccaggggaaatgacgctaacccatttcacatttgggattacttttgaagggctaacaattgaatacaggttgctatggaagaaattaaatttaatagaatcttattcttctaggttggggtttagcaaacttcttggcaaagggccagatagtaaatttagttttgtgggctgcgtatgatctctgtcacatattcttctgtgttttttgttttttgctttttcaaataccctcttaaaactgtgagaatcattcttaagggctgatcggctttagcccatggggggactgtaatttaccagaccctgttgtagaagccaccagaagtcacttgcagccatttcaaagcaactggccactattaaaatatcctctgcgtacagaattttgtttctaccctgtatgtaatcatcattagacatgtaaatcccattctaaaggtcaagattattatatgtgcttcagggcaacaaatgacttagcaggagaaggattgtgccgtttttttctgtatggtgctgtctggatgcagccctcgctggtgtaattacctccttctctgatcgtatctcagtaatcctgacagaagattaagaccacactggccccgacttaagaattttatacgactctgttgcttctaaaccctcatattcaattgcctttggtgtgtgtccaatgtaaaaacagcctcattgtgttattaaaggggagttagatgttcaccctgggaataaacacggggttgccctgccaccctccccaccctttcactgatgtgacatgattccctaagtaacttggacaaatcacttattgttttgttttctagccccagctgtaacatgagaattcatatctgtccattggggtatgtgatgaagtttagctcattattacctgaaaacgttctgaggtccttaggttaaaaaaaaaagaagaagaagaaaaatgaactgtccaatcttagaggttccctcatgggcaaactttaagaacagcttcatattgctaatgattgagaatcattcttgatccacaagtcatgatctgatgtgaggttcgatgagcaaggctggtacctcccatcagctggtggtagacaaaatattaagtggtggcaggggcctatttgtgatgttctcccagggtgcacagcccatggcttacttgaatagtgtgttttagggtttgttttcacaatcaagttctaattgaacccagacatggcacaacttttgcacctggcttctttgagatggtgcctattcatctttcatatttctcaagacactgggtcatttcttagctctttcttttggagaaaaaacagccttcacatctaccactctcactcgtaagtgaccttctttgacttcttcattcatcttcctgatcctctaagtttccacatggtcaagtttggatccaggacccaatatcctgactgatacttagcaagcaaaggggctgctgtctaccatttcatcattacacaatccagaatatgttctgtgtatgttttgcccaaaagtgtgttacttcaccctcacaaatggactcacagggatcctctcccatgcctgtgcacatcccttgcttcccacccagctagcccctgatccttccaccagcctcccactccactacagtcactctgaatttgggcgtttctctccacacccgtctcccacccaccaggcacaccaacctctctatgtcagcaactgaagctgttctctgggggccctctgccaaccccacagtcaggccatattctcaccccttggtagtatggcaaaatatgaaagatgccacgtgaaccctttctggaatgtaaatgtgttgcctctcttgctctggaagggccttgagcctctgggatgaagttggttctgaaactgaccaagtctaagccacgttccctagaagagtgatctgtgccccagcaactcctcccacctcctgctcccagactcccactccctattcccaccagaaacttccctcttcagccctggacactgctggataatgcactagagagcgcttatcaattaactgtcttctaccacactcagcaaccctttctgcagttctttctattcaacacagataatatgagcagtatagactagcataaaagaattaggaaagatcaaatgcttgaaactttatttcaaccagttcaggaccccgagagctgcctcccaactttgcctcttccctcatctgccttgaaatagcctccttgactgcagcattcccagcccagctcaggatttcccacttgtcccagcctttcttcagtccagttctcctcccagttaaatggagatatgaaataaatgcccacatgaagtgcatgccaaaattgattatgctaacttaaagtgttttcaaaagacacgagtggtattacaggcatttaaatatatttctaaaaaacattatattatgcaaaatgtcaaacatatggcaagataaagggaatcatataatggacccatcagctttagcagttatcaatatggccagtcttgttttatctattgccccacctgtaccccctactttccacccagattgttttgaagcaaatcccagacctcatatcatttcatttataaatttaactttaaaaatgtaggctattgtcactttatctgcagtttctttcttttttgcagtctgctaagatgttttcttatgctggatggacgcagacctgtaacaccctgtttttcatcttctccaccatatttttcatcagccgcctcattgtttttcctttctggtgagtagaccggtgatgtgccctgcctttggtcagtgtgcagaggtggcctcagtgcatggttaccctcagggcattgccctttccatacgtgggtctccagttatttgtgtcaagtgcagttggagaaaagaatgtgatggagccatttttataaataattaaaacaacactctgtggtgtggaaaaggcttattacaacgggagatggaaaatgtgtgacctgacgggcaagcagcagctcttactctgtcttgtttcatggatgtagacctttctttgtgattaacagcttttctagtcactcaatgaaaagtcactgtccaatcaccagttctctaaaagagaggtatgttctgtgttacaataattatagccattacttgaatgccagacactggattaggtccttcccatatcttggctctagtctacacaataactcataaggatgagtattatcacttccacttcccagataaggaaaactgatacttgtttatttcattctctatgaccactggttctaattatggtttgagtatcctttcgatatgattggctctcgatcagtctgttgattttgtttagccacagaccagcaatgaaaagcatatattacatctcccatgacaatcatttccttgggaagcataatgttccatgtgttgattgacagaaaccagagtaacatgtggggaagacttagatggtttggaaggaacagcttttaaccaaccataatttggggctagtctgggaacttgggatcctccaaacagaagacttagtgctgttgaagagcctagatgcaggggaaatggatggagactcaagttccaggcctcattcttaagtgtatagacagcacccttggctggcatccagggaaatccagccagagaggtcaatgccctttcctggaagccagctgcattctttagaccatgtgtattcggcattttctggagaggaacaacagagtgtagtggttaagttgctacatgtgagagtccatcctggatttaaatcctgactccacacttacgacctttgtgatcttgaacaggttataccacctctctgtgcctcagttttctcatatgtaaaatggaaataagggttggcatgaggcttaactagtttatatagtttggaacaatgtctggtactcagtaaagaatcagtaaatactacctactataattaaacatattaatgagtatctcagaatttgaagttcaactagaatcaaatctaagataaatgtctcagatattttccttggttgataaatcattaccatcacttttactttgactgagcaagtgtgtttgtgaaattttagtaatggctgggcatggtggtgcatgcctatagtcccagctactcaggagcctgaggttggcgggggggtcacttaagcccaggagttctagatcagcctgggcaacatagtgagaccctgtctttaaatatatctatatctatatctatatctatctatctatctatctatctatctatatatatatatatacacgtatatatatacacatatatatagacgtatatatatatacatatatatgtgtgtatatatatatagagagagagagagagagagagagaatgatagcaattattgatagaataatattgacttgctgatgacagttgggcatagcttttcagtgtgactttcatgacactatcaatccagcatttgcccctcagttcgccatgtcccaaaggcactacacgttccaattgcctgttgctgtataacacagcatctaaaagtctagtggcttaagacagcagtgggcaaactttttctttaaaaggccagagaatatatattttaggctttgagggccacctatgatcttttttgcaagtttttattcattttattttgttttataatcctttaaaaatgtaccaagccatacttacttagctcatgggctgtacgaaaacatacacccaggttgcaggccggattttacccacaggccatagtttgcagacctctgtcttaagacaacaacatttattaattattattattattatttctcatggttctaggagtcgattggccttggctagatgattttcacttagggtctcttgtgtggttacagttatatggcggctgggcagtcacatagtgtctagagtcctcaacacatggctgaagtcatatatagaaaatcaggctaggtgcagtggctcacgcctatatcccggtactttgggaggccgaggcaggtggatcacctgaagtcaggagttcgagaccaacctgcccaacatggtgaaaccccatctctactaaaaatacaaaaaaattagccgggtgtggtggcacatgcctataatcccagccactcgggagcctgaggcaggaaaagtgcttgaacctgggagacggaggttgcagtgagccgagattgtgccactgcactccagcctgggcaacagagaaagactccatcaagaaagaaagaaagaaagagagaaagagagagggagagagggagagagggagagagggagggagggagggagggagggaggaaggaaggaaggaaggaaggaaggaaggaaggaaggaaggaaggaaggaaggaaagaaggaaagaagataagaaaatcagctggctgatgctgcttgtgcttattggctgggacttcagctgggggctgtccgctggaatacccacagcccctctagttggccttggcctcctcatcgcatggcacctgcatttcaagggtgagcatttcaagagagtgctagagagatgctgcatcttttttcataaacagcctcagtagtcacatcacgtcatttccaaccttgtattttttattggaaccaggtcactaaatctgactcatattcaagggaaggaaaactagactccatttcttgatgggagcagtttcgaagaatttgcggatgtttttaaaaagcacacaccatggaagctctaggtccagggaactctctgagaagtttctgcaatattgctgccatggttggcttttgatttagcaatggagaacattcacctcagactatcccatgatgtctcaaaataaacaagcaagcttacttacccataaacaattgagcaacacagtggtgctcagtgattgtcggggtagtgcgctattttcccacactgttgtctttaaaaaccctacatttaagaactcattctcatgccagcatttctggttttcaaggagaattgagttacatgtgtttggcattttcttgatctttatactgaattcacttgcccattggagagggcagccagtactcctatttgctgtcttcaaggagttgggttgcaaataaaccaatatgaacagacttgactgtaaaataaaacgaaacaggccaggcacggtagctcacgcctgtaatcccagcactttgggaggccaaggcaggaggatcacctgaggtcaggagttcgagaccagcctggtcaacatggtgaaaccccatctctactaaaaatacaaaaattagccgggtgtgatggcgagtgccagtaatcccagctactcgggaggctgagacaggagaatcacctgaaactgggaagtggaggttgcagtgagccaagattttgctattgcactccagcctgggtgacaagagtgaaactccatctcaaaaaaaaaaaaaaaagttcaaaacaacagcaaaaacttttcctggtaaaaatatttctgtattgacgttgactgattctcattgtttggaaagttgagaaaaacctcaccaagccattggaagtttggcagatcaattttcaatggtctctgaaggaagtatgtcaatcagagagggagcttctttcaggtacagtgtactgctctagtttaaatggtcttcccaccagcatgaacttgccaccagcacaatcatcttcatggagtcaaaggggaagatttagttccttgttgttagcttggccccaaccctctgtctaaaacttataactctgtagattcatttttcgaggatgctttattctatccaaatgtactgggattttactatggagcaagcaatgtgcagatcataggtatcattggagggtggcttaactaacctatttcaccattcagacattttagaggcactgtgggcggcagtttgcaatctagttgctctgttcttctttccagctgcttttgttgcacatcctgtggtgatatacacggtagggcggggcgaaagctaactggggttgtgcccatctgagatttgtctggaagccttgagaaggagagctggagtgtgtgcatttcccttgccctttctttgacctttctctgattttccccagcctcaagcacatttgcatactctcctaacgagtctccctttcatgtccagccactgcactcttttacttctgaggatcttatcccattctcagtcagcatctgcaagagttagttacgttggttttctaagcattgtttcattaacattaggcagaaattcaaaagcacactggtcaaattgttttaatttaattgcctggtaactccatctgtttgcattcctgttcaaaaccatttaaatcgcaggtggatgtttttcacactgtattcccaactattgttcttaaaaatgatttctctagtttggaattattggatgtatctatcttcttgagcattatccaaatactcacagagagttattaggctagaaagacctttctaaggccaggcaaaccacttcctctgactactaacagttttcctccacaaataacaagagcagatcgtggttccacgcaggtaggtccacctgaagggaaggtgtgtgtgccctgttttgctggttttgcaacctgtgagttcagtgtctgtcacagctgagtgtgcagggggcagggtggcttgttgcttcatttcttgaattcatcacagctgggtgttacgaacagtacaaggggagtgagacccagctcatgcctttcaggagtgcattatataaggcagtagagagatctttgtgtctaaccctgtttcatgtggttgaagactattcacattgacctgtgtttctcagatgtctcaaaaagaaaaatacaaaacattttcaactgcaaataatactgaaatacctagctcccttacttccaaggatacatatgcttgtaaggtttctccctcaccactggttcactggacttcagatttcagcgtttgatgatccagctattacaagtgtagaaaaatggtaccctgggaagtccacatgtgaaagggaatattatcgacaatgagaccatgtaaatacttggaatggctaatagagaaaggagagttttaaaaaacagagaaagataaagctgaaagcacccaacagtgctcttagctgatgttcatcagtggggacccgggatgagggaatgatggacccttcttttcctctgaaggcctgaagccttggtcctaaatgagaagcagagggcagagcatcggttctgatggcaccatggtcagcttagtgccgtttgcgcaaccagcaaagaaaaggaaggtacaaggcaagaaagactctgttgaagctgggccactcccttgagccaccactgcagatatgtatctcagaactagactttccagttccacacctgatgaaggagactacctgttctaccacatgtgttcactgtctcactccacaggggcccttagaagagctctcctatcttgcccatgtgcttggtaccttctttatgctatttttgagttcacgaagaacagctacaacaatcacccctcttcaaaccatagaatcctagaataaggaactttatttataatgtagtccaatccttttattcatgtattcatttatttagaattttttttttttttttttttttctgagacagagtctcactctgttgccaggctggagtacagtggcctgatcttagctcactgcaacctctgcttcccgggttcaagcgattctcctgcctcagcctcctgagttgctgggactacaagtgcatgccaccacacccagctaatttttgtatttttagtagaaacggggtttcaccatgttggccaggatggtctcgatctcttgaccttgtggtctgcctgcctcagcctcccaattttagaaataattttaagcttacaaagaaatttctagtatactacagagaacccctagatatactgtttaccagttagcattttgccccatttactttgtcattccttctctctctacttccccaccacacacatgtatgaatatacatatttgtttctgaatcatttgcaagttgtaaacatcaactaaataattccttgtgccctaagtaattcagtgtgtattgcctaagaagaaggacattttcttacataatcacaatacagttatcaatcgcaggaaatgtagcaatctaccttccatgttccaatttggtcaatcaatccaatgatgtcttttattgcttttccccctgactgtgtggggatccagctccagatcacgtattgcatttagctgtcattcatctggaacagttgcttacctcttctttgtctttcatgtcgctgacattgttgaaacatttagacaccacatttatttctcagatgaagagttaaggtacttccaggatcacatagctggttatggaagaatcaagactagaaacaggatatttgaaacacagaacagataggcttcaaattaaatttgaaagtagggttaagagtgtatcatttgccttcactaaatatttattaagttttcttcaactacccagtcatttagaaacttaagagatcactgaggtagataattgttcacctgtagaacaagtatttgctatcctaaaagggcttaatgctcatacccacaattagcaagaaaataagacccttaccttgcaattttcattagacaaatacaactttttggtggttgccttagctagtccagcaaaaccagctaatatttataccaacactgcaatttattcaaaccatgccaactccagtgattggaagagctaaaattggaaacaaaactgaaaacagaaaaagctgagttttgcaatccaagggcatggtagtagcttatccatttggaaaggttaaatccagtggacagggacaaagtggttctaagaatttaggaatatagcagtctttcggcattctttatgaaaaggaaaattccattcagttgctgtaaggtggtgactagcgataatgtgcaagtgttgtgtgttctatgcatgtgcctgcacacatgtatgcacgtgtgttaggaagagagctgggaagggcagatggaattttttttctttttcccagtcttcttttagcgtagaaggagaggaaacttgagagactagaccatcctttattgaagtcttgaaattttaactgtggcatcatagctggttgttacccgtgccacaatggctactcccctctgactcctgttccacttctttggcctccagtcccctctgtcctcttgcagagaatgttcaggcagcagagtccccattcctcggatcctgcttaccctctccaaagtggactcctcctcttccccttggcaggaaatccagccatttcaggagcaccctcttggggggtgttgctctaactgtgttactggtgtaagttctctgcagtaggagagggctagttgtgggaaagtagtagtggccatagtggtagtaagagtaatagttgtaactatcatttttgaatacttactatgtaataggcactttccatttgtcaactcattgaatcctcataaccacctgggtggtgttctcattttacaaaagaaactgaagcccagagagattatggaacttgctaagatcctgggagccctgattgaaatcttgaagactccagcgccaattccactggcctctcctctctgcccagaggctcagctctcttagaagacatttgcatcttaatggcagcttctttcattctgagggctatacagtttgtaaagctggctgtgtgtctcctgggagcctctagtcaaaggaggtggtggaggggcagctagttttacccagtgactaaggaactaaggctcagtgacttatgcaggtttcgagccaagaaattagtggtgttgagccttgaacccagctctgatattctgttccacatgtgtcactcctctttctaaaaccagccaagcttcctgttgctctcacaatgaaggccacacctccaccctgacttgcaaggcctacctgagatggcttcttcacctctcccacctcatcttacaccacccttcactgccactcctctcctttaagccacactggtcttcttttagctcctcgaattttccatgatgcttcccacttgacagcctttgtacatgtagaaccctgccatatgccctgtcattttctttctttctttacatggatcacaatgggcaattttatgtttagttaattattcacattctccggtagactgtgtaaagaaggtatttttgagtaggtccttttgtcaataataacactgacaaattcccaataggggacctagtaaggggcaaggccctgagccagacaagggaaggacccagaggtgaaggtgtcctggccacggcctttggaaagcttgcctgctagtgaggaggggagagccaggaggaagggaataaattcaggggtgaccagaattacatggaaacttttgttgtggagagacccatgctttaatggatggaaaggggttcagttgaaaagagaaagtacattctaggcagaaagagtacagaataaggcccaaggatccagcaaaccagaatggcaagtaggtttttacatgtatcatttcctctaataagcctataaataaatgtgggtaccagaaggtaaaccctactagtttaggggttttggtccctctcattcattgctatattcctggctactaccaagtgtcaggtagcactttagtaggtgctcagtaatggtttattgaataaataaggtaggtactctctgctcgcattttacagatgaggaaatgcacaaataagtgacatggtatctaagtagtaaagccagaactttaagaaaatatgggaaaatatgttttatattgatggggctgaaaaaggacctttaaagcataacatgtatgcaaagtataaaataagcaattgacagatttgatttaaaaatttttttaattactttgccaaaaaaatcagtattgaaagaaaatactggactgtataaagctaattaacataatttaaaaatagtgttgatatctttagtatataaagagcatttaagaatcaacaggaaaaataaatgctccaatagaaaaatggacagatgccacaaaagcagttcataaagaataaataaaagtagccgagtaaaataaccaataagagatataaatagatgtataaatatatatagtcactatacattaaataaaaatatgaatataaacagtactctgttattttaggtggagactgataaaatacaatattggtcaatatctgaggaagcagatactcttatatattgggtgcaagaatataaattggtatagtctttctggaaagcagtgtaacattatattccaaattgtaaaatgagtctactctttgattcaggattttagctattctaagtggataatcaaacaattacatcaaaatgtttttatagaaccacacgtggtggttcatgcctataatcctagaactttggaaggcttaactcccttaagcctagaagttcgagatcagcctgtgcaacaaggcaaaaccctgtctctacaaaaaacaaaatacaaaaattggccaggtattgtgccgtataccaggagtcccagctactcaggtggctgaggttggaggattgcttgagcctgggaggtagaggctatagtaagctgtgatcatgcctctgcactcctgcctgggagacagagcgagaccatgtctcaaaaaaaaaatgtatttacaagtaattctcacagtattctttctaatataatgaacatttgggaagaatttaaatgtctattaataagggattagttaaattatgatatatctataaaatggatttctgtgaagccattatatatggtgatacatagtaggggttggcaggctatggctcaaaggccaaattcagcctattgcctggttttgttgataaagttctattggaacacagacacacacactaatgtatgtactttctatacatgaattagtttatgtaatgttagctgtcatggctgcttttgtactgtaatggctgaattgagtagttgcaacagagaccaaatggtccagaggcctgaaatatttattatcttttcctttacaaacaagtttgctaactcttgatatgtagctttgtttattgttgtggaaagctctctgtaacatgttattgcatgaaaaaagtagggtacaaaaatcacacataggtagtgatcacctcgttacataaaagcatgtggtgataggaggggcaaaatagaagcactttaaagaatatagttttgagagagatatcctaaatcgtttaacaaaatattctgggttacctgtaagttgtgagacttcaggtgatttttcattccttaacctctatatatttttctgtaattcctaaatttttaaaagcaatcgagttattacatctttttttttttttttgagatggagtcttgctctgtcacccaggctagagtgcaatggcgtgatgtcggctcactgcacgctctgcctcccaggttcaagcaattctcttccctcagcatcccaagtagccaggattacagatacctgccaccacacctggctaatttttatattttttagtagatatggggtttcaccatgttggtcaggctggtcttgaactcctgacctcaggtaatgcacctgcctcagcctcccaaagtgctgggattacaggcatgagccactgcacctggcccctgtttttcaaacaaagaacttgaactgataacttacaaaagaagaaatagagctactaagcagacataggggaaatgttaaggccttgcaaataatgtaaactgaaagtattttatcttttaaattaacaaattttgaaactatttcatactggttctgagttcagtgaaactcttctttcataaattgctggtggccttataaatagttacaatttaggaaaataatttggcaacattttagtaccttttaatatacaatcttgaattttaatatctttaatgtacaccttaaaacagtaatctcacgtttagaaatatatagtttcatagaaataatttcagtttatgaaagactatatacatcaagttgtctaaatagcataaaatgtctttgatttaaagctaaatgtaattgaacataaaatctcacaaatgttatgtttactgcagtggcaaaaatatagaacaatatgaagtaccaacaaaggtatagaacaactgacattctcatgctttgctggtgggaatgtaaagctaccactctggaaaatagtttttcagtttattataaagttaagcatatatttaccagatggcacacaattctacccctatatacttacccttgaaaaatcaaaacttctgttcacatataaatatctgcatgaatatttatagcagttctattcataaatgtcaaaagctggaaacaacccaaatgctcctcagtaggtaaaaaaacagtgatgcagccataaagtggagtgccactcagtaataagaaggagcatgctattgataaccatgacaactgaatgaatcttaaaagcattatgctgtgtgaaagaaggtggccttaaaagctcacacaacgtatgattccatttatgtccttggaagacagaccaaaggatacagagcaaagtgtttgccaagtttatgtgtggaggagggtgtggcaataaagggatagcatcacagaatttttttggcaagataggctgttctgtatcctaattgtagtggtgtttaaataaacctatagacatattaaattcattgaacaatataccaaaaaacagtaaattttactgcatgttaataaaaaaattaaaaaattgtataggaaaatactggaagagaatgcatgaaaattacaatattgtttgtttaaggtgatggtgttatggacaattttcttgtttccccaatgttacatgaaaaaaattatttctataactaatatacttacaaacaaacctattgaaagactctaaattcatagtgctatataagtttgagaaataaacaaatagcccttcatatggcaataatatcttttttttttttttttcacggaatcttgctctgtcacccaggctggagtgcagtggcacaatctcggctcactgcaacctccacctcccaggttcaagcaattcttttgcctcagcctccccagtagctgggattacaggtgcatgccaccacacccagctaatttttgcatttttagtacaaatggggttttgccatgttggccaggctggtctcaaactcctgacctcaggtgatctgtccaccttggcctcccaaagtgctggtattacaggcatgagccaccatgcccggcccatatggcaataatatctgaagacactgtgcatcttaggtcatcaggagcagttcaaattgtgtccaggagcctgtttatgaaactaataaagcatacaatttactttaggaagcagaagtgttaagtactcatggaatttttgctttgttaaagcttcttttatttggaaaatgtacttttgtagaattctctattcacctttgatgccaaataaatgagattgtgttttaaggcaataataacctcatgtaaacatgcattatcttatttgttcttcaaaatcctctagccccatcaccagaaggtaaaaatggttagtgtatgcttttgtttgaaaaaaggaaaccaaggtacagaaacattccagtttaaacactgggtaataaaaatgctgtttctttaacttttcttcaggaagacagattgtactttttttgttgcttgccagtaatgatatttaagataatattatcgtatcttttcttttgataattttctgggctttattagaaacgaaatacatgtatggcttaggagaaaaactatttgttttattattgaaaattcataggtgctttggttgtaatgaaattctctcaactgtttggtgtttcaggattttatattgcacgctgatcttgcctatgtatcacctcgagcctttcttttcatacatcttcctcaacctacagctcatgatcttgcaggtccttcacctttactggggttattacatcttgaagatgctcaacagatgtatattcatgaaggtaagggctgtccaaatattattgctcttaatgtcattgccaggttaatggtgaggcccggactgttgaatgttcaagttaattcatagttttaaccagaattcttttttcttgattttattatttttgattaaaattttggaaaaatagagctagatttttcataagtaggtctttaaggtgcttttaagaaattgcttttattagaagatatgttatttttgacatttttaaaatgtcaaaacttcaaaaattataaaaattgctgcttgtttttatgcttgaagaaaatttttaaacttttgcttattgatatgtaatatttgtgcatatttatgtgatattttgtacgtgcatagaatatgtattcaggacatttggggtatccatcatcttgagtatttatcatctctaagtgttgggaacatttcaagtcctctcttccagctattttgaaatatacagtgtattgttgttaactacagtcacctgctgctgaagattggaatttattccttttatctaactgtaagtttttacctattatgcagcctttcttcatcttctcccaaccccaccaacacacccttcccaatctggtgtctatcattctactctttggtatattgtttttttttttccttgggataaatatgcagtagtgagattgctgggtcatatggtagttctacatttagtttttgagaaatctgcattccgttttccatagagattgtactaatttacattcccacaaacagtgtataagagttccctcttctttacattctcaccagtgtctttcaatcactttttgcctttttaataataacagttttaactggggtgagatgatatctcattgtagttttcacttgcacatttccctgatgattagtgatgttgagcattttttcacatgtctgttggccactgtatgttttttcttcagaaatatttattcatgtcctttgcccctttttaatggaattatcattattatttgttgttgttgttgttttactgttgagctgtttgagttccctgtatattctggatattagtccattatcagatgaaggatttgcaaatattttctcccattcaacaggttgtctcttcactatgttgattgtttcctttgctgcacagaagcttcttagtttaatatagtcccatgtgtctattttggtttttgttgcctggcttttgaggtcttagccattgaatctttgcctagaccaatgtcctgaagtatttccctgaagtacttcccttatgtattcttcaagtagttttatattttgggatcttatatttaagtctataatctgtgttgagttgatttttgtatatgatgagagacagagatctagtttcaatcttctgcatgtggatatccaattttccccacaccatttattgaagaggatgtcctttcccccaatgtatgtatttttttatttctgtgaaaaatggcattggtatcttttttttttttttttgacaatgccttgctctgtcttcaaggctagagtgcaggggcatgattatgactcactgctgcctcaatctcccaggctcaaacaaccctcccacttcagccactcaagtagctgggactacaggcccatgccaccacacttcactaatttttaaaatttttcgtagagatggggtctctatgttttccaggatggtctcaaactcttggggtcaagcgattctcttgccttggcctcccaaagtactggaattacaggtgtgaggcactatgcctggccaacattgctatcttggtagagattgaattgaatctgtagatagctttgagcagtctggtcattttaatgatattaacttttctaatccatgagcatgggctgtctttccatttgtttatgtcctcttcaatttttaaaaatcagtgttttgtagttttccttgtagaggtcttttacctccttggttaaatttattcctaggtatttttgtagttattgtaaatgggattcccttattgagttctttttcagctagtgtgtcgttcatatatagacactattttttatgttgaatttgtatcctgtaactttactgaatttatttatcagatctaaggctttttttggtgaagtctttaggtttttctgggtataagatcgtgccatctgcaaagagggacaatttgacatcctcttttctaatttggatgccttttatttgtctcttgcctgattgctctgactttaatgtccagtactacgtcaaacaggagtagtaaagtcagcatctttgtcttgttctagtttttaaaggaaaggctttcagcctttcaccatttagtatgatgttagctatgaatctgtcatatatgcccttcattatgttcagttatgttccctctatgactagtttgttgagagtttttatcataaaaggatgctgaattttattaaatgctttttctgcgtctattgagatgatcatatagattttattctacattctgtcgatgtaatgtatcacatttttttatttgtttatattgaaccaaccttgcatccctgggttgaatcccacttggccatggtatgttatctttttgatgtaatgttggatttggcttgctagcattttgttgagaatttttgtatctatgttaatcagggatattgacctgtagtatttttttgttgttgggtccttgtctggttttgatatcaaggtaacgctggccttgtagaatgagttagggagaattccctccacttaatttttttttttgaatagtttaaggagaattgctgtaaattcttctttgtaaatttggtggaatttagcaatacagctatctggacctggacttttctttgttgaaagactttttattactgatccaatctctttactttttattggtctgttcaggttttctgtttcttcctcaatcagccttgggacgttgtatgtgtttatgaatttaaccattgcctctaggttttccagtttgttagtgtatagttattcactatagtttctgataatctttatatttctgtggtatcaattgtaatgtgtcttttttgtttctgattttctttattttggtcttttctccttttttcttggtcagtctagctagcaatctattttgtctatcttttcaaaaactaacttctaattttgttgattctttgtaattattttcagtctctttcatttagatttgctctgatctttgttatttctttccatctattaattttgcatttggtttattcttgctttcctagttcattgaagtgcatcactagattttttatatgacatctttctacttttttgatgtagaagtttattgctataaacttccctcttagcactgcttttgttgtatctcataggttttgatatgttgtgttttgattttcacttgtttcaagaaatgttttgatttccctcttaatttctttcttgacctagtggtcattttggagcatgtttttttccatgtattcatacagttttcaaagtttaatttccatgtattcatacagttttcaaagtttctcttattattgatttatagttctaatccattgtggtctaaaaagatactacatataatttcagtttttttaaatttgttgagacatgttttatgtcctaacatatggtctatcctggagaatgtcccatgtgctgatgagaagaatgtgtattctatagccattggatgaaatgttctgtaaaagtctgttaggtccatttggcataaagtgcagtttaaatccaatgtttctttataaatattccgtccagatgatccatctaatggtgataggagggtgttgaagtctccaactattattgtattggacttcatctctctctttagtaatatttgctttatatatctgagtgctctattgttggctacacatatatttagaattgtatttcttgctgagttgatctctttatcattatataatggtcttttttgtctatttttactgttttttgaattaaagtctgttttatctgtatctgatataagtataggtgtttctgcttgcttttggtttccatttgcaggattatctttttacattcctttacttttagtctatatgttttgttttgttttggttttttgtttgttttgttttttgttttttttgagacagagtcttgctctgtcacccgggctagagtgcagaggcacgatcttggctcactgcaagctccgcctcccaggttcacgccattctcccacctcagccttcctagtaggtggaactacaggtgcccaccaccacacccggctaattttgtttttgtatttttagtagagacagggtttcaccatgttagcccggatggtctcaatctcctgaccttgtgatcttcccaccttggcctcccaaagtgctgggattacaggcatgagccaccatgcctggcctagtctatatgtgttttcacaggtgaaataaacttcttgtaggcagcatatagtgagtcatttttaaatccattcagctagtctatatcttttaagtggaaagtttaatctgtttacattcaaggttagtattaatatgtgaggggttatttctgtcattttattaattaatttctagttgttctgtatatcctttgtttctttctttctctcttactgtttatcattgtggtttggtggttttctgcagtggtaacatttgagtcctttctcttcttcatttatgtgtttgttctaccagtatgttttatacttttctgttttcatgctggtagatatgattttttcacttctggatgtagaactgcctgaagcatttcttgtagggccagtgtagttgtgatgaattcccttagtttttgcatatctggaaaatactttatttcttctacatttataaaagataagttttctgagtatagaattcttggctaacaggttccccccctcccccactttcaggactatggccatatcatcccattttcccctggcctgtaaggtttctgttgttagtccgatgatggttcccttacaggtgactagacacatttctgttgctgttcttagaatgctatctttgtttttgacttccaacagtttgactataatatgcagtaaagacctttaagaatcatgtctatttgtgaatctctgaacttcttgtatctggatgtctaaatctcttgcaaacttgggaacacttcagctattattttgttaaataggtttctatcttttttattttattttcacctctgaaacaccaaaagttcaataagttgtttcccttacagtgtcccatatgtcctgtaggctatgttcattcttttttcatttttttctttatttttatctaatggagttctttcaaaagacctgtcttcaagttctgaaattctttcttctgcttgatctagtctttttttttttttttttttttttgagacagagtcttgctgtgttgccaggctggagtgcagtggcacgatcttggctcactgcaacttctgcctgccaagttcaagcaattcccctgcctcaacctcctgagtagctgggactaccggtgcatgccacatgcccagctaattttttgtattttagtaaagaaggggtttcaccatgttggccagaatggttttggtctcctgacctcatgatctgcccaccttggcctcctaaagtgctgggattacaggagtgagccaccacacctggccaatctagtctatttttaaagcatttgaaagtattttgtatttcattcaaatgaattctttacttccagaatttctgtttggttcttttttttacgatctctatctctttggtaaacctctcattcacattatgaattgtttttctgatttccttgtattgtttatctgtgttctcttatatctcactgaggttctttaatataattatattgagttctttttcagggatatcttaagtttgtttttattggaacctgttgctggagaattattgtgttttttgaaggtattagatttccttgcttttttatgtttccgtgtccttaaattgatatctacacatctggtataacagttgcttcttacattttttaaaatttgttttcatagaggaggatattttcctgaagatgtacttgcagtggttgttggtagggaactttggttgtgattctgggtgcatgcaatattgtagtcattatgtgattttttttggctataaacaacctcagtggtgtctgtgaatttttcattggctcagggtgcagttattggagactgtggtgaggttttgctggggatgggaatgccaagtgggctagtccttgggccccagtggtggcagcagtgggccaaatggtcctgtccttgggcactagtgttagcagctccaggcgggctgattcttgggccttcagatagctttcccaggtgccaacagtggcagtgatggggcaggaggtaggttggcctttgggcccctaggcagaagctgtggcatgggcaatggcggtagcagtcacttaacaatcctctggctcccaagtggtctgcattggtgttggcagtggctgcaatgggataggacggccagtccccaggcctgcaggttgcatgtgcaggtgagtactagctgtggtgatagcagcaggttaggtcggcacaacctgggaggagtgctcagataccaatcattgtgaacacagccagttaatttctgggccttccaatggtatacttgggcagtagggggagggagtgtggaaccaggcgaagcagacctatcctcaggccctgctgtggtgcacgcatgtgctggttgtggtaggcaggggcagggtgccctgctactgggaagagtggggttactttcagtggcagcacctgcaggtggttggctagggagcacaagcttcatccccaggtagcagctgtggatagggtaacctgtccttaggacacttgtaaatgcatgctgactctactactaaggaagtggggtcactgccagtggcttgcactttggccctggtagtggcatccagcagtgggacacataaaaatgtgtgatggcacactactggggatatcagggccactgtcaatagttactgcttcagccctggtagcaacagccagccacagcagtgcccccacatggggaatgtcagtggggctccaggaatgtgtagatgcagggactgttgtgcttcagcacaggctgcagtttggcggaggctaggctctcaaaatggcactgtgctgtagctgcttaggactcagggggtatgtgggacctcgtatgagctccttctatggagcaatgcttttgtgtcaactctaggcagctctctatgttagtcttatggcctgtgagagttgagagcctctcctgtggctaggattgcaggagtccatgatgggaatgtggactactgagatctcttacttacccttttcccacattggggagtatctccaggttcttagctgagcagacggtcttggcttccctttccttttttgccttaagtgtttcctgtcacttctctgttgaattctactcttctcttagaggatctgttcaaagtgtgattatctactcgctatttggttcctctgtggaggaggcatgtacccgatgcctctagttattctcgattttgctgctttttaaagaatcccctaatgagtcaaaacttgctccagttttggacaacctttatgatgataattgaataatacttcagagccttatgtttatttttattgaatatccaaattgcacataacgctctcccccgagcttgttccccactagcctctgaaatactgtccatcattttactatgctttgtttctgaaaacatcttctctaaataataacaaattgattagactattgattcaaacttttagactattgaaggttttttgtttgtgttgttttgaattaggttctgtgctttaattccagaacacagtgagggaaaggcaacagagatgaataagataatccctgactttaggggaaatagcccaccatctagtgggggaatgttcatctaccggcaactaactatagcatacagaatgtcctgtggtacatacaggccccagaaacttgccatggaagaaaagctaaaaagagaaattaactcaagggaccaggaaatgtttcattgagtgatggagtttgagttgagcctttaaagcaagtgaaaaagatcgcatttctgctttgtcttaaaatcataacctaccactaagtgttgatgaaaagagtcaaactctgtaaaatatttgaatagatttatcctgaaccaaatacgaatgaccagtggcccatgacacagccgcaggagatcctgagaacatgtgcccaaggtggttggactacaacttggttttagacattttagggagatataagtcatcagtcaatgcatgtaagatgtacattgctttggtctggaaaggcaagacaactggaagtagggggctttcaggtcataggcagattcagagatttttctgattggcaattgcttgaaagagttattagataactcattagataagagctgaaatcaatagaaaggaatgtctgtattaagataaggagttgtggagaccaaggttttattatgctgatgagcctccaggtagctgacttcagtgctgttatgagaccttaaaaggtgccagactgttaattcattctctcctggatcagaggaaagatccagaaaggaaaggtgattctccgcaaaatgtaggtttgctccacaagagacagtttggtagggccatttcaaactatatcaaaggaatatattttggagtaaaatatttcaatttctttcaggggctgctatctattatgtgatgttatactagagtcaggctggaacttggtgtcttattgctacaaaagtcagtcttaagatctctgttttaatgttactgatggtcagctgtgcctggattccaaaggaaggagggtgtataatgaggtgtgtctgactctcacttcccatcatggcctcaactagattttcaggtttacattggaatgtccttggctgagagggggtccatcaggcagttgggggtttagaattttatttttggtttacataagggagttttcattaaggatcttttgagttgaaagttatagctggctcacatttaggtgttactatccgtgtataatatatacagcactatattgtcagattgagtgacttgtgtgtaccaaggatgctggcagttagtctgataagctcagtttttaatcaactctttgattaattagttttccaactttagtaaatgtgcctcaaagatcactgaagagttggcaaaggaaatggaaactgccgtaattgacctctgagttttctaccatctcttagcttctagatcttcacagaggtatgggaaattagcccacatctcggttaatctaaagaaaaaaaaaaaaaaaaacctgagaagtttcttcttgaactgaattactgatgaccttgttttcttgagagccaacttttcctgttaaagttgtggtgccaaaaaaaaaaaactttcattgaatggttctagtttattaaagttctaaatagcttttctgtgatctctgaaaaagttgttttcatgcacgtctgtgtgaagagaccaccaaacaggctttgtgtgagcaacaaggctgtttattgcacctgggtgcaggcgggctgagtccgaaaagagagtcagtgaagggagataggggtggggccgttttataggatttgggtaggtaaaggaaaaaggggggttgttctctagtgggcaggagtgggggtcacaaggtgctcagcaggggagcttttgagccaggatgagccaggagaaggaatttcacaagataacgtcatcgttaaggcaggaacaggccattttcacttcttttgtggtggactgtcatcagttacggcaggaacaggccatctggatgtgtatgtgcaggtcacaggggatatgatggcttagcctgggctcagaggcctgacattcctgtcttcttatattaataagaaaaataaaatgaaatagtggtaaagtgttgggacggtgaaaattttgggggatggtatggagatataatgggcgatgtttctcagggctgcttcgagtgggattaggggcggcgtgggaacctagagtgggagagattaagctgaaggaagattttgtggtaaggggtgatattgtgcggttgttagaagaaacatttgtcatttagaattattggtgatggcctggatacagttttgtatgaattgaaaaactaaacggaataagagaaggagaaaaacaggttttaaaggactaagaattgggaggacctaggacatctaattagagagtgccaaaggaggtgcagcatagccttgcccgcaaaaattatttatttactttaagagttaagagtggcggtttggggatagcaccaggagatatcagctgtgatggcttggagaaacagtgtaaactggcagtgtaaacaagagcagggcacgtatgagtagttgagaatggtgaataggagtacgactagacaggagatagtagggatgacaagttttttggggcacagtccaagttggtctggtgtctggaatgagactggggcctaataaaaaggagcgtctatacaggagctcaaatgggctgtaccttgtagcattccaaggacaggcctgaattctgagaagggaaagtggtaaaagtattgtccagtcctttttaagttggtggctgagcttggtgaggtatgtttttaaaagaccattagtccgttctacctttcctgaagactgaggactgtaagggatataaaggtttcactgaatactaagaacctgaaaaaacgcttggctgatttgatgaataaaggccggtctgctattggactatatagaggtgggaaggccaaaccgaggaattatgtctgacagaagggaagaaatgaccatggtggccttcttagaccttgtgggaaaggcctctacctatccagtgaaagtgtctacctaaaccaagaggtattttagtttcctgactcagggcatgttgagtaaagctaatttgccagtcctgggtggaggcaaatccctgagcttgatgtgtagggaagggagggggcctgaataatccctgaggagcagtagaatagcagatggaacactgagaagttatttccttgaggatagatttccacgatggaaaggaaatgagaggttctaagaggcgggctagcggcttgtactatagcacagcctgcctttgctggtgtgtggcgattacgcctggtggaactgccatccataaaccaagtgtgatcagggtgagaagcagggaagaaggaaatgtggggaaatggggtgaacgtcaggtggatcagagagatgcagtcatgggggtcaggtgtgtatccggaataatgtgggaggccggattgaagtccgggccaggaacaatggtaattgtgggagactcaacaaagagtgagtacagctgaaggagccggggagcagaaagtatatatgtcaggtgtgaggaagaaaatagattttggaagttatgagagctgtagagagtgagttgagcatagtttgtgattttaagggcttctaaaagtattaaggcagcagcagccactgcacggagacatgatggccagcctgaaacagtaaggtcaagttgtttggacaaaaagtctacaggatgtgatcctggtccctgtgtaagaattctgattgcacagccctgcacttcagctgtgtgtaatgaaaagggttgggatgagtcagggagagctagaatgggggcagtctctaaagctgtcttcaaggaacggaaagaggagtggggaaaggatttaggatctttggggtcagctacgtttccttttgtgagtttatagaatggtttttttaggatggcaaaaccaggtatctaaaggtgaaagtatctaaccgtgcctaggaaggaaaggagttgttgttttgtagaaggtgctggggtttgagagatcagtcggacactatcggcagggagagcacgtgtgtctttatgagaattatgctaagataggtaacaggtaaggaagaaatttgggcttgactaaagtaatgggggctgtctgtgaagctttggggcagtacagcccaggtaatttgctgagcctgatgggtgtcagggtcagtccaagtgaaagtgaaaagaggctgggatgaagggtgcaaaggaatagtaaagaaagcatgtttgagatccagaacacaataatggattatggagtgaggtattgaggataggagagtatatgggtttgacaccatggggtggataggcaaaacaatgtggttgataaggcatagatcctgaactaacttgtaaggcttgtctggttttaggacaagtgaaatgggggaattgtaaggagagtttataggctttaaaaggccatgctgtagcaggagagtgataacaggctttagtcttttcaaagcatgctgtgggatgggatattggcgttgagcggggtaagggtgattaggtttcaatgagatggtaaggggtgcatgatcggtcaccaaggagggagtagaggtatcttatacttgtgggttaaggtagggggatacaagaggaggacgcaaaggaggctttggattgggaagaagggcagtaatgaggtgtggctgtagcccaggaatagtcagggaagcagataatttagttaaagtgtctcggcctaataagggaactgggcaggtggggataactaaaaaggagtgcttaaaagagtattgtctaagttggcaccagagttggggagttttaagagatttagaagcctggccgtcaatacccacaacagttatggaggcaagggaaacaggcctttgtaaagaaggtaatgtggagtgggtagcctccgtattgattaagaaggggatgggcttaccttccactgtgagagttactggcagctcggcgtccgtgatggtctagggggcttccgaggtgatcgggcagtgtcagtcttcagctgctaagccgagaagatctgggaaggagtcagtcagagagccttgggccggagttccaggggctctgggagtggctgccaggtgagttgaacagtctgattttcagtggggtcccgcatagacaggacacggcttaggaggaatcccaggctgcgagcattccttggcctggtggccagatttctggcacttgtagcaagctcctgggggaggcagttctggaggaatgcctggccgctgcagttcaggtatttggaagttcttgtgtgctggagatgtggctggggtttgtctcacagtggaggcaaggaattgcaactcagaaatacattgttacttggctgcctctattctattattgtacaccttgaaggcgaggttaattaaatcctgttgtggggttaaagggccggaatttaatttttggagttttatttaatgttgggagcagattgggtaataaaatttatattgagaataagacggcccttttgaccttttagggtctagggctgtaaagtgtctcagggttgctgccaaacgagtcatgaactgggctgggtttttatatttgatgaaaaagagcctaaacactatctgatttggaataaagaaaaaggagcgttaaccttgactatgcctttagctctccagccacctttttaagagtaaattgctgggcaggtaggggagggctagtcatggaacaaaactgtaagccggcctgggtgtgaggaggggaggtgatataagtattatatggtggaggagcggaggctgaggaagaattgggacctagctcagcctggtgaggaggggagaggtcagatgggtctgtagaaaaggaagattagaaagactcagcgacgcttggggttgggactgaggggacaggcgggagggaaagaaggaagatttgggatgagttgcactgggaacacagactgggggggactgatgtgtaaaagaatgcctggacgtcaggcacctcagaccgtttgcctattttacgaaaagaattatttagattttgtaggatggaaaaattgaaagtgccattttctggctatttggaaccactgtcaagtttgtattggggtcaagcggcattgcagaagaaaataaggcatttaggttttaggtcaggtgcgagttaaagaggttttaggtttttgagaacacaggctaagggagaagaagggggaatggagggtggaaggttgcccatagtgaaggaggcaagtttaaagagaagggtagagacacggagggaaggggttcgggtgtttttaccctccagaaaagcgagaaaggggttggggcgtggaagtaaggggttggggcacagagataagtggtcagggtgcagaaataagggattggggtgcagagataaggggtcggggcatggaaataagggatcggggcacagagataagaggtcggggtgcagaaataagggatcagggcgcagagataaggggttggggcatggaaataaggggtaggggcacagagataagaggttggggtgcagaaataagggatcagggcgcagagataagaggtcggggtgcagaaataagagattgaggcacagagataagaggtcagggtgtggaaataagggatcagggcgcagagataagaggtcggggttcctgcccctcccccagaaaagcgggacttgccgctaagggtgaaggaccaaggcaggcatccctgcgtggtctgacacctttgaaacatgggtgaataatcagagaggcgtccctgcaatgattaaacaccaagggaaggctgccttccctagtccgtgaccagtgccggagttttgggtccatggataaaacatgtctcctttgtctctaccagaaaatgaaaggaattgaaattaagagaagggagaaattgaagtgtggtgccaagattgaaaggagaaagaggttgagggatagcgagagaggttcgagaagacagtaaaaagaggccgcttaccggatttgaaattggtgagatgtttcttgggctggtcggtctgaggacctgaggtcgtaggtggatctttctcacagagcaaagagcaggaggacaggggattgatctcccaagggaggttccccccctccagtcacagcaccaaatttcacgcacgtccgtgtgaagagaccaccaaacaggctttgtgtaagcaacaaggctgtttatttcacctgggtgcaggcaggctgagtccgaatagagagtcagtgaagggagataggggtggggccgttttataggatttgggtaggtaaaggaaaaagggggtttgttctctggtgggcaggagtgggggtcacaaggtgctcagtaggggagcttttgagccagaatgagccaggagaaggaatttcacaagataatgtcatcagttaaggcaggaacaggccatctggatgtgtatgtgcaggtcacaggggatatgatggcttagcttaggctcagaggactgacagttgtcttatctctgagtgagtgataaagtcgaagtaactgagacaagttaaataagaactggatcagttagacagtttgtacctgcagtagttggtgtgaaggaaaggccctggactgagcctgtaatgattgggtccagccttccagaagctcctgtccccatggagaaacggttcccttattaactggtgagagacaataattacaggcttgaaaaggatctgggggagtgaagcttggaaaacagaagataccctagtttcattgtgattttcctatgtctgatctctaatgggtcatgccaggcctgattagaaacccagcaggttggggagccatggacaagaattcctgatttctcatgttgtcctttggagaagctgtttccaattgcagtttgacaggagttgtggaggcccccacagccataatccttgcagtttgtatgacttcagcagtcttgcatgtgtactctgttttccacagcagtggcaaaactggctgtgaaatcagcttattcctccaaagccgtaaagcctccttttaaagaacactatttgaaggcatagttgcattgcaaaggggaggagagggctagcggctggagttaaaattcttagagggataactaacaaatccattttcaactctatttaatcagcgtttagcatttaatgcatttgattgttactaaggcgacagattcttggatactttacaaatgaaattgcagatgttcatgtgcctccaaaaatttcttttaaatcttgtaacagagattgtgagtttgttccttcaattccttacacatggaaaactctcagtaagtaactttaaatatgcaaagaatacaaaatttggaaaacaaaccaccctgttttgggtagcaagttacaaaataatgtattaatcatttttggtctccatgaattttcatggcagactgaaaagaaggtgattatacttttaaaatagcatttttggtaatagtcacatcttattttttctaaacaataaggtcattgcatttgatgaatgagaaccttccactatttgcttttgctcttgaatgccttaaaataaaaatatcactataatttcaaaactctagcttatatggaccctgcttagcaggcatcctgctgcttgagaacaaggcttggcactgaaacttatctagttcctataaaatggttgattttgtgatgagctactagcccatacattacatcagaaaatatgacaggctgacactcatcttgtcattttctttgctaacatgagaagtgccttgagaggaaattagaaggaaaatagtatgcttttgtttaatattacttaagaggacttgatcatccttaagcttttattctcttctttctaaatatcatcctggatcctggccagctcaagcatgtctgtgtgatatcttgtgctggtgagtagtcaagacgtgcggggggaactgtagcatgcagacacaaaagccagcatggagaaaccagccccttggcaacctgcccagccatctgcaactcaacaggcaggatctcttcagttcatagaatgacactttacatacactgaactgttttagctaaagagaggaacatgctaacaaacatgaggaaaccaaagcctagaccaaattcacacagtaatttcatggcaaagccaagactagaacttgagtctcttaacttgtaacacttcaccttttaaattattctttatttgagttaaggtaaaaaaattaataactagaaaaaccagaaaattagtttaaaatacttgtatggagttataaaatagtgaatattcaaaaattttcaagagttaaaatatatatatgtatacacctactgggtacccacaaaaatttcaaaaaataaaaataaatagtgaatacaggccgggcacagtggcttatgactggaatcctagcactttgggaggctgaggtgggaggatcacctgaggtcaggagattgaaaccagcctaaccaacatggcaaaaccctgtctctactaaaaatacaaaaattagctgggcgtggtggtgtgggcctgtaaccccagccacttgggaggctgaggtgggagaattgcttgaaccagagaggtggaggttgcagtgagccaagatcacaccactgcactccactccagcctgggagacagagtgagactccatctcaaaaaaaaaaaaaaaaaaaaagtgggtacataatccaattgatgagtaatcaagatcatagattaaaatgcagcataaatcttgtaacttacttttgaactttttgaaagcataagaaaatattttgtttttcttctttttttaatctcacatcacttccaagtaaagcggttagatagctaagagcacaggttctgtgtagattgaaacgtcagctctcccattcactggcaatgtgatcttgggtatattactttgttcattgcctcggtttcttcacctgtaaaatggggatcatgatattagtgcctgcattgaaggataaagcccttagaacagtgggtggcacatagtaagcacatgataaatgttagctgccattgtcatgatcaatatgatcaatattactactttagcaggttctttctaccaaactacagagagcctgggaatgagtcgttgtcgggcagttggctctcagcaagcctcttcattttgctcaggcagacagtgctgcagctgacattgtgagtccttgacttgaaacccaaggctccagtgacagttttctaagctgtcttttgccagttgactttcatgactcacattccaggtggtcatttttgacacatcctcgtagatgtcaacatgttagggaagaacacaaagtctgtaacatccaagaagcctctaagtctattctgctagtaggtaagagtgaatgtaaaactgcactttcctgaacaataatttataaaaatatcacaaagactgattgttgaaataaagtatgttagaaatgctgtcaatgtaggccaggtgcggtggctcatacctgtaatcccagcactttgggaggccaaggcaggcggatcacgaggtcaggagatcaagaccatcctggctaacacggtgaaacactgtctctactaaaaatacaaaaaaaattagccgggcatggtggagcgcacctgtagtcccagcttctcaggaggccaaggcaggagaatggcatgaacccaggaggcggagcttgcagtgagtggagattgcaccactgcactccaacctggatgacagagtgagactccatctcaaaaaaaaaaaaaaaaaaagtcaggaaagaacagatgctacttcctataggatcatcatgattaccacatttagatgttgcagtgtctctctctgttgctgatgataacagcgtgtcttttcagctcttaattttaggcaaactgacctctgatggaaaacagtatactaggatgtttaaataagtaaaacaatctcttttttttgtacttttagaatcccctatagctggtgtcctatcactatgattatgcaaaactggtctgttagcattattaaaaacatttttcttattagcatcttattttatttatttatttatttattttactttaagctctgggatacatgtgcagaacatgcaggtttgttatatatgtatacatgtgccatggtagtttgctgcacctatcaacccatcacctagtttttaagccttgcatgcattaggtatttgtcctaatgctcttcctccccttgccccccagccccgataggcctcggtgtgtgatgttcccctccctgtgtccatgtgttctcgttgttcaacttctacttacgagtgagaacaggcagtgtttggttttctgttcttgtgttagtttgctgagaatgatggtttccagcttcatccacgttcctgcaaaggacatgaactcattcttttttatggctgcatagtattccatggtgtatatgtgccacattttctttatccagtctatcattgatggacatttgggttggttccaagtctttgctattgtaaatagtgctacaataaacatatgtatgcatgtgtctttatagtagaattatttataatcctttgggtatatacccagtaatgggattgctgggtcaaatggtatttctggttctagatccttgtgaaattcaccacactgtcttccacaatggttgaactaatttacactcccaccaacagtgtaaaagcattatttctccacagcctcaccagcatctgttgtttcctaactttttaatgatcaccattctagctggtgtgagatgctatctcattgtggttttgatttgcatttctctcatgaccagtgatgatgagctctttttcaaatgtttgttggccacacagatgtcttcttttgaaaagtgtctgttcatacccttgacccactttttgatggggttgtttgtttttttcttgtaaatttgtttaagttcattgtagattctggatattagacctttgtcagatggatagattgcaaaaattttctcccattctataggtggcctgttcactctgatgctagtttcttttgctgtgcagaagctctttagtttaattagatcccatttgtcaattctggcttttgttgccattgcttttggtgttttagtcatgaagtctttgcccatgcctatgtcctgaatggtattgcctaggttttcttctagggcttttatggttttaggttttacatttaagacttcaatgcatcttgagttaatttttgtataaggtgtaaggaaggggtccagtttctgttttttgtgtatggctagccagtgtaaaacaagcttttattccagttttctttggtactccctgtttcctcaaagaggttctggctgctggcatctgtttccaacagcagacctgtcttccctgcagtcactcaggactgacttagtcacacgagggatcttccgtactccaatttattgcatattagctccagtgtgctaaagttcttgctttgtatgttttctggcaatggttttcaaaatactagttctttggaggtgctgggctacccaagtcgtttggccagcaggaagtcaaaggaggcagttgcaaatgaaagggcttaagatgagagctgcttcctgagagcacggcattgatatctgtgggattccaatcctgcctctctttcctctgtcccaaatgtggactgtgatgtcctcagaaccacagaccatgtcttgctgaagttggaaaggagggtgagggagggggaagaaccaagtacaagaaactctgacatcccttgttcccattatttttaaacgtcgtttcccaaaacgaaatgaatttttatgtaatcctgaaaggaagagatagtctcctttttattagtagagaaacagacgcacacacacagatgtcgtatatggaatctgaactttagaccggggcacaggcacagtttgtggcctgttaataaatctgcacattcacagcaggatatgagagttttattaatgtgttcttaggccagagagcttggtaaaaacaggtatagggaggccccatgctggccagcactgtccctgctagtctcccactgttttctgtggccacaccctccctgtggccatctccccacccctactacctaagtctcagaagagagttttgtgtgacacaaaagaaaccttattcctgaacactcattcagtgtgtagatgtgggtaaaagaaattagtttttcaaacattttcattttgatttatcatgtgggctttagcacctgagtgatttatgatgcagatggcttgatctgtgctctgatttgggaacagcacgcatgccgtctgtggaactctgggtgctcaaaggggctgtgttcttcaaagggtgtctccttggcacatgtgacaggcccaggaagtcctgagcaaagcagtcctgggcacgcactcttcgcgtggatccatggccaatgacctggatgcctgagctaagacatcatggaatgcctgtcctttccaatgggcctcggcctcaagattcctccatgcaactgacatacttctaggacgtcttcagtctgagcctggaaacatggtcacgtctttcaaaggaatggaactgactctgctgagtcatctagatgggttggaaacccagatccactcctcatagctctccacagaggcctgactgcaggggctaaggccagaacaggccctacatgggcagctacctgtttaatgtttggatggtagcccctaaatctacctgcatgcaagacagcatgaagaatgtggagaaagcccaggcctcaagagggccccagggtattggctgtccagaggaagagagtaatgggggagatctaagtcagcaaggctgtggcgaaagcctgaggcaagctttgcccactttgaagctttctgttgctatttgttcctgccatgtcagttgagagtgtttgtgtgtgcatgtataggtgtgtgtgtgtgtgcacatgtgtgcatgggcatgcatacacaggaggatctggggataccctgggcttccacacctgtgagggagtgagggtagctgggctgggcaaagggagaagttgaactctgatgtgggtgcaaccaaggcctccaccaaccctacagagagctctagttctgggtggcccttcagagatgacccaattgagccaaggaggctgggcctctgtatttggacattaacctgttactggatatgggctgccatctagagaggggaatttgtatatattttttcttctccttatagataagctgaacagtgttctgtttcctaggaaacctgaagctatatgttcatgttgattctatagctgtttggggagaatggtggggcggcggggggaatttgtaatcaggctaccaccattgttcttcagccccagaagtcctcaagtcatttgcaatcttaggtacttgaattgaattttttttttttttttttgagacagagtcttgctctattgcccaggccagagtgcagcagtgcgatctcagctcgctgcaacctcagcctcctgggttcaagcgattctcctgcctcagcttcctgagcagctgggactacaggtacccgccaccacacctggctgattctttgtatttttagtagagatggggtttcaccgtgttagccaggatggtctcgatctcctgacctcatgatccacacacctcagcctcccaaagtcctgggattacaggtgtgagccactgcacccggcctgaactatttttaataccaaatttcataccacataccttgcaagtgaccttgacaatatctcagttatggagagctccgcagagcagcacagaaccagatggtagcccctcagataccagtcatcaagccctaccacctcttccgtgactctgtttctgcaggctaaatacatacaattctttcgaacgtacgtgactctgtttctgcaggctaaatacatacaactctttcgaacgtacctcctaagacatgctgtggagtcttttcacctacctcatcactctcttgttctattttatccagattatttaaatgttatacctagaagtcagcacagttttctagatgtggtctgactcatacaaaatcaagcaggtctgttttctctgtttttctgaaaattctgtttctattgatgtaggttagttttccattgctgttagtcgcattatgctgttaattcatactgagcttgaaattgattaagcctccatgtcttttccacatgaactattgttaagcaacatttcctccactggggaattgtctggtgctgagagtggtttttcgtttttgttggaagttatatttctttttgttaaacttcattttgcttgatcaggttatcattccagccttttgtttaagaatgggaaagcctgacatttggtgacaggtgcttaaatatttttgatgacctgttgtttaaaaggcctattaaagccaggagtggtggtacatatttgtagtcctagctgtttgggaggctgaggcaggaggtttgcttgagctcaggaagtcaaggcttcagtgagccatgattgccccactgcacaatctagcctggaaacggaacaagaccctgtctcttaaaaaaaaaaacaaaagagggcctattaaaggaactcaggagtatgctatacaaggcagctcatgaaaacgtcctaattattttgtttgaatcagaggaggattgtaattatacttaagcctaacacacaagaagatctactactcacaccgtaaagaagatctcccaggattccagactttttgcctcagatcaacttgttactgctgtgttgctagcttgttacatgctagctatgttgactacagctaactagagtggcttgggcgttaatagaaaaatacagccaggtcccaacacagaccagttaaatctacagaggtgagatcgagacactggaatttttgacagtcctcttcttccactaaatgattctaatttgcatcctaggctgagatctacaagattaagcagagaaaaccagctgcatgtgtcttctccccactggaaaaatgtccatggtgccactccatttactgggtctattttttaaaaagcggagatcactatactcttccctacatttgtaaagtcaattggcatgacctcaacaaacattcccatcttgaaaatattacaaaattagtggacttttgtgttacattgatgttctgcactaaaagaaaaaaaaactgataaaaattcagacttgaaaataagcacattgggattcttttgtagaaaaacagaattctttaaatagcacatttttctggagaatttaaaaacatgatttattttataaaatgattatttttaaagaaccatttattatataaagtgagacatacttgcaattttatgttgcctttctggactgaaaagttacttgtgaaatatagagactaaggaagtcaaagttatttgaaagcatggaattttagaagttgaaagacccttaggcaaccctctgctgcaactttttcttttcacaaagagtagcaatccagagagggtttgtggtctaacagacaaccatgctctccaaagtgcagtctgaccatcagcccaggtacagtccagggactgctagaaatacaatatctcaggccccaccagtgacctccagcatgagaatctgtagtttaccaagaaccctaggtgatttgcgagcatgttacagtttgggaagcactggtctagaaaattcatattccagacaactgaaaggaaaacggccacgcgtagccagagttcacagaactcaatttaaatttaatgcaactgccttgaggagggaaaaaaggggaaaaaactcaatttgtttttttctgtgaccttgtcaacttggataattagaacctatataacaaaaaggaatgtactttgctagtagttcagaaaattgaactgactgaatgtatttttttcatacagtgaaagctaaaaatttgctttcaaaacagcataaaatgcttattatatagctctttgtttcattgccaactgcggatttagacatggagtcattcaaagagcagtgggacattatgagtaattcacaatcttctgggcttttgacatttctgcaaagccacagattcccaagcacagcatttagttacagcacttcaaaaacacagcactatgattttatggaagctgtagtacagatgtcattcccagaggtgtaaggaaatgctgtgggcaaagattgttcatttagttcaaatgagcattttatcttattaacattagaatgtattttttttctcattgtcaagttttttgtttttgtttttgttttcttttggtcattctttttttttttgagacggagtctcgctctgtcgtccaggctggagtgcagtggcgtgatctcggctcactgcaagctccgcctcccgggttcacgccattctcctgcctcagcctcccgagtacctgggactacaggcgccccccaccacaactggctaactttttgtatttttagtagagacagggttccaccgtgttagccaggatggtctcgatctcctgacctcgtgatccgcccacctctgcctcccaaagtgctgggattacaggtgtgagccaccgcgcccggcttttttggtcattcttgcaatcatttttgaggaatacagatgaagcccaagtgaattatgtataagcatatatatatataaatatataaaaaaaaatacaccaaaagtaaagccaaaagtgtagacatccggatttgactttaaatttattgtgctcaccttttcttttggtggagattaaagtggtgggaatttgtgtattaattgagtgatgctggttgtgttacacatattgtacaatacggggtgatggctgtggataagtatgtttatttaagaaacacagatggtgaagcttttccgtgctgtgtcatgtgaggatcaactgaaggatgggggaatgtttagctggaagaggagttcattatctttaaatgtttggaaaattaaccaatgtttgaagggagtacacagacttcttttgcctggtacaaaggggtagaacttggaggaatgcgtgggcgctccagggaggcagagatcagccccaaatatgaaaggaagcagatagtgaatgactgcagagacacaggcaggggtgtgcgtcttctgctagggttgttgtaaagagcctatcaccatcaaatagaaactggattagaagacacttaaaggtccctttcaaacctgtaggtctacagatactgctgtttcttacgtaataccccttccacatcgcagtgctactccgatagcctccagagtttccctcctggactgtgacctcggcctcccaagtatgccagctgggctccttccagccatttccacacagtggcagagagcactgctatagaaaccagctcccccggtgcagaagctcactgaggacaaacaccttgtctgttttctcactgatacactgcaaacacccaaaacagtgctataaagtggcttctagttgggtttagaaatgaatttgaatttctgaccatgacctgtgaaattcattatctgatctgtgcttatttgaggcctcacctggggtcaggccctgcctttctcagcattcattagctgtgctgtccttgctaatccccgagcatgcaaggctctcacatcgcagggcctctgcccacgttgtttcttcttgaaaggtttattccactcttctccggctactcctgttaaactataggttacaacttgagttcatttccttaaggccttcctggcatcagcctcatctaagtgagattcctctatttaaatatcatagtattctctacttcctaacatgcatcaaacctgtaacgatgtatttcttattgtgtgtttgattctgtagcattcagttctttcaatagattgtaagttatttgagaacagaccattatatctccaatgtcttgcacagggcacagggtattaaaaggattttttgaactggtggttctcaactggagcagttttggccttcaaggatatttgacaatctgtggagacatttttgtctgtcacaagtgggaggtgccactagtatgatacagataactggaggtgcttactgctagacgtcccacaatgggcagcaaggtcccggaatcacctggcccaaaatatccacagtgccgaggttgtgaaccttggggtgaatgaatgaactgtctgtcttttggttgattgtcctttgtggcaaggtgtttttcccaaattattcattgctttcccactgccagtgtcttctcatccaggggaaactttgatttatgcaggaacagccaaacacatgattccttgagaaaccaagctctccaaaattagctggttagtatttctttacatggaaatattggcatttaaaattattcaaatgataatggttttgaaagaaaacagttgccagccatttccttttgagataaggcaactgcattgaaaagttttgatggatggagaaaatgagattgtagcaaatttgtcagttgtaatcccaatctgagaaaacatttactctgatagcactctgcactataaccttcagttccttcactgttatgtaccatgagggctgggaaggacacaccaggggaggccgttttgactctgccaaacagtggttcctcattcattctaattcacttagtgacgtggctctctcattgcttttttcaccacctgacctctttaccttctgagtctaactcagtaaaactgttcccatcctgggggtggccaccttcacctgtctctcggcaggaagcacagaatctgagtttgagctacacaactttttgtttctagctcaagccatcatatttatgaggaagacttgttagaagaaaatgaatgacagtttctacctattgaaaaatttcattcggctttgtagtcagagtctgggacagtacttcccaatcttcatcacttcatcgtacccgagagattgatgtttgtgcagcacacaagggtaaactgaggtgggcctcaaagcaggagaagacagtacaagtaatccaggcacctggggctctggtagcttcaggctctgccttgctaccccaaggcctgagaggattaatgtctcagcataacttttaaccctttcctggcacatccgttgggaatttctggtatagaatagcctcacgtaatggccactcatctatgggccaatagatgataatgttattcatttccacttaatatgggctgatagattggcattgcctaagaacaagtcatattttgtttatccctggagaagcacagatgagatacttttaaaattttccttattcggaattcttgccaacaatagcactttcgctcctccgagacagggatgcagcgctgtccagcaggaaccatctgaagtagccatcacaaggcctgctgcagaggaccgtatgtcagaagaggtctctcaggaccaaaacatacgcagctgtgtcatggagggccagccagtggggcacacacccctcggctgactactgtgttcccttaccctgaggtcacgggtgtgggcttgccaacccgtgtcagctcagaatctggagcctggccacagagatctgatatagcttggacattgctgaagacagcatttggagagctgaagagtgcagggacccgtatcaaaggacccaattgagtgtaacaggctggaaatgaagtacctcataaaaggcagggattggggataatttttaggattttgttttcagcaactgagtgggtgggagtaccatttgctaaattatggaaggccagagaaaaaggtggtgttaaggggaggagactagagtttaaagactgttagacagctgagggattttctagctattgagtttttgagtttgaagcctgaaagaggcccacacgggggatataaacttgggagtcatctacagttatacagtattcaattaatgctatggtattagattaattcattcactctttcaacacatatatccagagtgcctactatgtactaaatgagatcacctacgagaacccagagaagacagatggtatattccagtatattcctactcattttattctctctccctctctttccctgcagagatggccactgtcttgaagctggtatccttcctctcatgcctctgtatatttattatgtctggatatagttacgggcattagagtattattttctgtattttaaaactttatgtaagtgatatgagctgatatataaatgtgtagcttttttcactcattataagactattcatattgatgtatgtctccttgtgaacatgtgtgtgaatttctccataaatggaattgttaggtcaaatttattttattttttatttttcactatctcaaaggaactcattttaatttttttattatgcaacatttagtttattaattgaatatgaaatttttgatgtgtatatagctgatgagcttttttttctttttcaactttttttaaaataaagaaaataggtttaattgactcacagttctgcaggctgtacaggtaacatgactggggaggcctcaggaaacaatcatagcagaaggcaaagggaaagcaggcacttcttacatggctggagtaggaggaagagagcgaagtgggaggtgctacacacttttaaacaaccagatctcgtaagaactcactcactgtcacaagaatagcaaggggtaaatccacccccttgatccagtcacctcccaccaggcccctcctccaacattcagaattacggtcaacatgagatttaggtggggacacaaatcccaaaccatatcattctgcccctgacctctcccacatctcatgtccttctcacattgcaaaatacaattatcccatctcaaaagtccctcaaagtctcaactcattttagcattaactcaaaagtccaaagtccaaagtcttatcagaaacaagctagtctcttctgcctatgagcctgtaaaataaaacagcaattaattagttccaagacacaatgggggtataggtattgggtaaatactccctttccaaaagggacaaatcagccaaaacaaagtgggctacaggccccatggaagtctgaagcccagcagggggtcattaaatcttatagctacaaaataatctgctttgactccatgtctcacattcagacgacactgatactaggggtgggctcctaaggccctgggcagctctggccctgtggctctgcagtgtacatcaccagcggctgctctcaagggctggtgttgcgtgcctgtggcttttccgggtgcatagtgcaagctgtcaataaatctaccattttggggtctgggggactgtggccctcttctcgcagctccactcagtagtgccctggtaggaactctgtgtgggggctccagccctacatttcccctctgcactgccttagtggaggttcttcatgagtgctccaccccttcggcagatttctgcctggatgtctaggcatttccgtacatcctctgaaatctaggcggaggctcccaagcctcactcttgccctctgtgcacccacaggcttaactatatggaagccgccaaggtttttggcttgcaccctctggaacagtggcctgagacatatctggggcccttttagccatggctggagctaaagcagctgggaaaatgccttggaggcatttttccccattgtcttggctattaacatttagctcctctttatgcaaatttctgcagccagcttgaattcctccccagaaagtgggtttttcttttctaccacatggtcaggctgcaaattttcttgcaaacttttgtgctctgctccccttctaaatataaattccagtttcagaacatctcttggttcatgcagatgagcatatgctgtcataagcagccaggtcacttcttgaacgcattgctgcttaaaaatttcttctaccagataccctaaatcatctcactcaagttcaaaattccacagatccctagagcaggggcataatgccagtcagtctctttgctaaagcaaggaaagagtgacctttactccagttcccagaaagttcttcatctccatctgagacctcctcagcttggacttcactgtccctatcactatgagcattttggtcacaaccattcaacaagtctctaggaaattccaaactttccctcactttcctgtcatcttctgagccctttaaactgttccaacctcttcccattacccagtttcaaagctgctttcacattttcaggtatctttatagcaagggcccactgctggtaccaagtttctgtattagtcagttctggcactgctgtaaagaaatatctggccaggcatggtggctcacacctgtaatcccagcactttgggaggccaaggcagacaaatcacctgaggtcaggagttcaagaccagcctgaccaacgtggagaaaccccatctccactagaaatacaaaattagctgagcatggtggtgcatacctgtaatccaagctacctgagaggctgaggcaggaggatcacttaaactcgggaggtggaggttgtggtgagccgagatggtgccattgcactccagcctgggcaacaagagcaaaactccacctcaaaaaaaaaaaaaaagaaagaaagaaatatgagactgagtaatttatggagaaaaaaatttaattaactcatggttctgcaggctgtacaggtaacatcgtgggggaggcctcaggaaactttcaatcatggtggaaggtgaagaggaagcaggcacatcttacatggctggagtagggggaagaggagctctttttcaacttttgttttaggttcagggggcacatgtacaggtttgttacttgggtaaattgcatgttgctggggtttggtgtacaaatgattttgtcacccaggtagtgagcatagtacctgataggtagttttttgatcctcacctttcccctaccctccgccctcaagtaggacctagtgtctgttgtacccctctttgtgtccatgtgtgttgtaagtgagaacatacagtacttggttttctgctcctgcattaatttacttgggataatggcctccagctgcatccatgttgttccaaaggacatgattttgttcttttttatggctgtatagcatttcacagtgtatatgtaccacatttcccttatccagtccactactgatgggcacctaggttgattccatgtttttgctattgtgaatagtgctatgatgaacatatgagtgcatatgtctttttggtagaacaatttatatttctttgggtatatacccagtaataggattgctgggttgaatggaagttctgttttaagttctttgagaaatctccaaaatgctttccacagtggccaaactaattcacattcccaccagtagtttataagcattcctttttctccatcacattgccaaaatctgttattttcttttttttttaacattttttttttattatactttaagttttagggtacatgtgcacaatgtgcaggttagttacatatgtatacatgtgccatgctggtgtgctgcacccactaactcgtcatctagcattaggtatatctccggatactatccctcccccctcccccccaccccacaacagtccccagagtgtgatattccccttcctgtgtccatgtgatctcattgttcaattcccacctgtgagtgagaatatgcggtgtttggttttttgttcttgcgatagtttactgagaatgatgatttccaatttcatccatgtccctgcaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatttttacatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgctgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccaccaccatttattaaatagggaatcctttccccattgcttgtttttctcaggtttgtcaaagatcagatagttgtagatacgcggcattatttctgagggctctgttctgttacattgatctatatctctgttttggtaccagtaccatgctgttttggttactgtagccttgtcgtatagtttgaagtcaggtagcatgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtgtggccattttcacgatattgtttcttcctacccatgagcatggaatgttcttccatttgtttgtatcctcttttacttccttgagcagtggtttgtagttctccttgaagaggtccttcacatcccttgtaagttggattcctaggtatttgattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgttgtctgcaaacatggtcaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagacaatcatgtggtttttgtctctggttctgtttatatgctggattacatttattgatttgcgtatattgaaccagccttgcatcccagagatgaagcccacttgatcatggtggataagctttttgatgtgctgctggattcgttttgccagtattttattgaggatttttgcatcaatgttcatcaaggatattggtctaaaattctctttttttgttgtgtctctgcctggctttggtattagaatgatgctggcctcataaaatgagttagggaggattccctctttttctattgattggaatagtttcagaaggaatggtaccagttcctccttgtacctctggtagaattcagctgtgaatccatctggtcctggacactttttggttggtaagctattgattattgccacaatttcagatcctgttattggtctattcagagattcaacttcttcctggtttagtcttgggagagtgttatgtgtccaggaatttatccatttcttctagactttctagtttatttgcgtagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggtttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacatgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagtggtttggagtgagattcttaatcctgagttctagtttgattgcactgtggtctgagagatagtttgttataatttctattcttttacatttgctgaggagagctttacttcccagtatgtgctcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtattaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatatagcacactgatgggtcttgactctttatccaatttgccagtctgtgtcttttaattggagcatttagtccatttacatttaaagttagtattgttatgtgtgaatttgatcctgtcattatgatgttagctggtgattttgctcgttagttgatgcagtttcttcctagtctcgatggtctttacaatttggcacgattttgcagtggctggtactggttgttcctttccatgtttagtgcttccttcaggagctcttgtaaggcaggcctggtggtgacaaaatctctcagcatttgcttgtctgtatagtattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacccgacctttctctctggctgcccttaacattttttccttgatttcaactttggtgaatctgacagttatgtgtcttggagttgctcttctcgaggagtatctttgtggcgttctctgtatttcctgaatctgaacgttggcctgccttgctagattggggaagttctcctggataatatcctgcagagtgttttccaacttggttccattttccccatcactttcaggtacaccaatcagacgtagatttggtcttttcacatagtcccatatttcttggaggctttgctcatttctttttattcttttttctctaaacttcccttctcgcttcatttcattcatttcatcttccatccctgataccctttcttccagttgatcgcatcggcttctgaggcttctgcattcttcacgtagttctcgggccttggttttcagctccatcagctcctttaagcccttctctgtattggttattctagttacacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcattcctttggaggaggagaggtgctctgcgttttagagtttccagtttttgtgttctgttttttccccatctttgtggttttatctacttttggtctttgatgatggtgatgtacagatgggttttcggtgtggatgtcctttctgtttgttagttttccttctaacagagaggaccctcagctgcaggtctgttggaataccctgctgtgtgaggtgtcagtgtgcccttgctggggggtgcctctcagttaggctgcccaggggtcaggggtcagggacctacttgaggaggcagtctgcccgttctcagatctccagctgcgtgctgggagaaccactgctctcttcaaagctgtcagacagggacatttaagtctgcagaggttactgctgtctttttgtttggctgtgccctgcccccagaggtggagcctacagaggcaggcaggcctccttgagctgtggtgggctccacccagttcgagcttccaggctgctttatttacctaagcaagcctgggcaatggcgggcgcccctcccccagcctcgctgctgccttgcagtttgatctcagactgctgtgctagcaatcagcgagactccgtggggtaggaccctcagagccaggtgtgggatataatctcgtggtgcgccattttttaagcccgtcggaaaagcgcagtattagggtgggagtgacccgattttccaggtgcgtccgtcacccctttctttgactcggaaagggaactccccgaccccttgctcttcccaagtgaggcaatgcctcgccctgcttcggctcacgcacggtgcacgcacccactgacctgcgcccactgtctggcactccctagtgagatgaacctggtacctcagatggaaatgcagaaatcacccatcttctgcgtcgctcacgctgggagctgtagaccagagctgttcctattcggacatcttggctcctccactattttctttttattcatagccgttctgactggtgtgaaatggtatctcttggcagttttgatttgcatttctgtaattattagtgattttgaatattttttcatatgcttgttggctgcatgtacgttttcttttgagaaatatctgttcttgtcttttgcccgttttttaatgtggttggttgttttttgcttgttgatttgtagaatccttatagattttggatattagacccttttcagattcatcctggctctgtgtcttcactcaaatctcatctcaaattgtaatgcccgtaatccccacatgttgagggagggaccagttgggaagtgattggaccatgggagcagtttgccctatgctgttctcgtgatagtgagttctcatgagatctgatggttttataaggggctcttcctcctttattgctcactcttctctctcctgctgccatgtgaagaaggtccttgcttctccttatgccacgattgtaagtttcctgaggcctccccagccatgtggaactatgagtcaattaaacttctttcctttacaaattacccagtcttgggtagtatcgttatagcagtgtgaaaacggactaatacacagtttgcaaatatttactcccattctgtagcttgccagctatcccagcactgtttactgaatagggagtctgctccccatcgcttgtttttgtcaactttgttgaaggtcagatggttgtgagtgtgcccccttatttctggctctttaatctgttccattgtttctgtgtctgcttttgtaccagtaccattctgtttgggttctgtagccttacagtgtagtttgaactcaggaagtgtgatgcctctggctttgttcattttgcttaggattactttggctatttgggggctcttttttggttctgtatgaattttataatttttctaattctgtgaaaaattacattggtagtttgataagaatggtattgaatctataagttgctttgggtagtatggccattttaacaatattgacttttcctatccatgaatatggaacatttttccatttgtttttgtcatctgtgatttttttccagtggtgtttttgttttacttcaagttgcaggatacagatgcagaacatgtaggtttgctacataggtatatgtgtgtcatggtggtttgctgcacctatcaacccattatctcagttttaagccccacatacattaggtatttgtccgaatgctccctcccctccctcactccctgccccccgacaggccctggtgtgtgtttttcacctccctatgtccgtgtgttctcattgttcaactctcacttatgagtgagaacatgcagtgtttggttttctgttcctgtgttagtttgctgaggatgatggcttccagcttcatccattccctacaaaggacatggtctcattcctttttataactgcatagtattccatggtgtatgtgtactacattttctttatctaatctatcattgatgggcatttgggtgttccaactctttgctattgtgaagagtgctacaataaacatacatgtgcatgtgtctttatagtagaatgatttatatctctttgggtatatgcccagtaatgagattggtgggtcaaatggtatttctggttctagttctttgaggaattgccacactgtttcccacaatggttgaacttgcattcccaatgcaagtttaatttgcattcccaataacagtataaaagcattcctgtttctccacagcctcaccaggatttattgcttcttgactttttaataatccccattctgactggtgtgagatggtatctcattgtgattttgatttgcagttctctaatgatcagtgatgttgaactttttctcatatgtttgttggatgcataaatgtcttcttttgagaagtgtctgttcatatcctttacccactttttgtttttttcttgtaaatttgtttaagttcattgtaggttctggatattagccctttgccagatgggtagattgcaaaaattttctcccattctgtaggttgcctgttaactctcgttatagtttcttttgctgtgcagaagctctttagtttaattagatcccatttgtcaattttggcttttgttgcaattgcttttggtgtcttagtcatgaagtctgcccatgcctatgtcctgaatggtattgcccaggttttcttccagggttttttttttttaatcattttgggttttacatttaaggcttcaatccatctttagttaatttttgtataaggtgtaaagaaggggtccagtttcagtagtttgcatatggctggccagttttcccagcaccatttattaaatagggaatcctttccccactgcttgtttttgtctggtttgtcaaagatcagatggttgtagatgtgtggtattatttctgaggtctctgttctgttctgttggtctatatgcctgttttggtaccagtaccgtgctgttttggtttttgtagccttgtagtataacttgaactcaggtagcatgattcctccagctttgttctttttgcttaggattgtcttggctatataggctcttttttggttccacatgaaatttaaagtagatttttctaattctgtgaagaatgtcaatggtagtttaatgggaatagcattgaatctgtaaattactttgggcagtatggccattttcatggtattgattcttcctgtcatgaacatggaatgtttttccatttgtttgtgttttctcttatttccttgaggagtggtttgtagttctccttgaagagggccttcacatcccttgttagctatattcctagatattttattctctttgtagcaattgtgaatgacagttcattcatgatttggctctctgattctctggtgtttctgtcaggttttggtatcagaatgatgctgacatcatagaatgagtttgggagaagtccctcctccttgattttttggaatagtttcagtaggattggtaccagctcttcttcatacatctggtagaatttggctgtgaatccatctgttccaggtatttttctggttggcaggtgttttattactattactatttcaatttcagaatttgctgttggtctatttatgatttcagtttcttcctgattcaattttgggaggttatatgtttccaggaatgtgtccatttcttctaggttttctagttcatgtgcatagaggtgtttataatagtctgtaagggtttttttttttttcttgtatttctgtggggttggtggttaggttaaatttactagatgctgccaacctatttttctaaccaaatgtatgagtgtttctttttccccacatgctcaccaactttttttacaatattatcagactattcaatatttactaggttaatgcacatgagattttatcttattatttgaatttgcattttactgattactaagattgagcatatagtatagtatagtatagtatagtatagtatagtatagtatagtatagtcgtcagttgtgttgacttttttgtaaattgcctgttcatgtcctttgcctgcttttctatcacattcggtttcttccttcttaatggtgcatatgagttatttgagctctttgtgtatcttgaatattaagatttgaaacaaacttcatttcaattttaatacaaattttgtgggcttaatcctctgtcttgctatgattattccttgaatgttgctttacttaaaatcccagagaatttttattttcaaaatgtttttgcagatctttgcctggttagagttgtgggactttcaagctgtgaatgtaaagctgtttttaaaggatgtaaaatatggcaatttggagaatatgttaaacaacagttttaatccccaatgcaaattatgttgatataatcaaatcattttctgcatccatcacaatttgttgatcaccacacagtctggcacatttttaatttattttgggttatatggatagtatgaaaaaaatctatgcatttttatcaaaagtcacatggtataatctgggctctgctgccactaagctgtatcactctacagggtgggactgagccctgtagctttcatctcatctggaaaatgaatgtcagaccagatactctccggagtctgtctaacatgaaaacttaatttttctcttaaaagctaattttaaaagccacagatttttacaaaatgaaatcatctcttaaggaattagatccattgatagtagcaagaaataattagtgaaaaatagaacatattctattttacactggttagttgggagagtataaaaagcaacttttgtgtctggctctgaaattcaagaagaggtattctgtatacgtggaacagctacaaaaattggctctatttttcttctataaatcagggaaccatggctaaactgatcttaaggtcatgttttaagcaacttggattcaaacttcacaggacttaaaagactttagggcaccccttataaatttgaaaaagaacaaagctgaagtactcaaacttcctgatttccaaacttactacaaatcttcagtaatcaagacagtgtggtaccggcataaagacaaacataaagaccatggtatagaatagagaaataaaccctcacatatgtatggtcaaataatttttgataagggtgccaagaccattcaatggggagtcttttcgacaaatggtgctgggaaaactgaatatccacatgcaaaagaatgaagttggacccttacctaacaccatacacaaaaattaacttgaattcaagcaaagacctaaaactatagaagaaaacatagggcaaataatttattggatatgacactaaaggcacagacaataaatgaaaaaatgggcaaatttgacttcatgaaaatttaaaactttggggcatcaaaagacaccatcaacagagttaaaggtaacccacaaaatgagagaaaatatttgcaaatcatatatctgataagggattcataaactgaatgtattgagaacttctgaaactcagcagcaacaaaactccaaatgacctgggttcaaaattgggcaaaggacttgaatagacctttctctgaagaagatacatgaatggccaataagcacatgaaaagatactcatcataactaatcattagggaaacgcaaatcaaaactataatgagataccactcacagctattaggagggttactattaaaaaaaccgaacataacaagtgttgatggaactgctgaatggtacagtcactgtggaaaacagtatggtagttctacaaaaagttaaacataggcttaaccacatgatccagcaattccacttctggatatatatctaaaagaattgaaagcagggacacagatattgtcctgttttcaatatctgtgttgatattcgtagcagcattattcacaatcactaaaatatagaagcaatccagcgaccattgagagacaattggataaacaatatgtgatatatgcacaccatggaatattattcagcctttaaaaggaaggaaatttggccaggcacggtggctcacgtctgtaatcccaacactttgggagcccgaggcgggtggatcacctgaggtcaggagttcaagaccagcctggccaacatggtgaaaccccgtctctactaaaaatacaaaaattagccgggcatggtggtgggcacctgtaacgccagctacttgggaggctgaggcaggagaatcacttgtaccagggaggcgaggttgcagtgagccaagatcgtgccactgcactccagcctgggcaacgagaatgaaactgcatctcaaaagaaaaaaaacagaaaacaaaacgaaggaaatttggacacatgctacaacatgaatgaaacttgaggacattatgcaaagtgaaataagccaattacaagaagacatatactgtgtgattccacttatatgaggtacttagaattgacaaagtcatagagacagaaagtggaatggtggttgccagaggctggggaaaggggagaagtgggggagttattgttaatgggtacagaatttctgtttcacaagatgaaaagagctatgggaatggatggtgatgattacacagaattatgaatgtatttaatcccactgaacacacttaaagatggttaacatagtaaatcttatgtgcattttgccacagaaatttaaaaaggactttagacaatgctttgacacttctagactgtgggaagtcagggctgttgtcttggtaatggtattctgtgtctaaaaaatttgataccagacaaagttaattaccatgtgatatgacaggttcaatcggttttcctgagcccctcaaaagaaaaggagaagcagaagttggaagtgcgtctatcgctttagggacactccagtgctctgaatgagtgagtcttggaatgtgaggcagttcgtctctatgcctctgctcctagaacacacccttcaaaggaaaactttgactttgatccaactttaatcaggggaaggtcattttggtcctaatttcagggttttcagtttctcctggtgtgttgtatgttctcaaactaaacgaggtctccctttgtagtgactgtgatttcaaccacagccactgaatgcaggcctcctgtgcctgctggagtgccaagctgataatatttgtcagtactggtcctgttgagtgatgtgagggttccatagcccctgttaggacaagtaacgggtcactattaagctaggaacttgtctctcattcttttcactgtcgttttgtgtaaccaaagggagtcgttgggggcagagacttctaaaagacctcgcaaaaatcatgaccatccccttccaacgtggagtgaataatattgctaataacattctagaccacccaggttgtttttggagaaagttcagtggaatactaggtacctttgctaggttatcagaagagcaatatgctctgtaatggcggctactgtaggaaaaccttcccaagggggagtcactctggcagatgacaggcgtgtgtgccacagtatgctccggccagggcaagaactgcgcacaaaatcattacagtcctgtggctgctgacacccaggtccacccctccactcttcaaagagggttttggatccttcttgaagcgtgtgttttcttgaccctttaatgatttgtaaaggggtcagggccaacaatttgcctaagaaaagttccaatagcccagtaacaaaacctacagggtgttggtgtgtggagagcaaatgggaagggcaacacaataagaggccagtagattcaaagaaacggactcacgctgattttgcgagcaaagtcttggcactcagtcaaagcagacaggtagagtttcagaaaataccaaggctcgacctctagtgagtacgtagatgccttgttccccctagagcatacttgattttgtttctaatttctatgaagtgttttaattactggaaaaaatctgcagttgcgatatggtttttctcagaatatgggtggtgggctgcactttttttaagctcttttgatttcagctgattagaaaaacctcatttttctagcataccttagccagtgtttttcaaactgtgagttgcaaatcatgaataggttgccaaatccatctcatagatctagaccatcattttaaaaatgaaatagaatgtagaacatgtccgtgtttgtctcacctaggaaacaatcatttattaggattaatttttattatttcaaatttatacctaaaggccagaactgatggcacctgaggcaaggtcagaatagggatggaagatgtagcgagacggggcacttggctcagaaggaggggagaaggcactttcttatacgaagagccaacctcatatagacctgggttgccagtctcctgggtgtcctgcctcatcaagtatttgtgcagcctactccagcaagggtctgtagagcattgctgttcaaggtgtgtaagcttagagtctggcttttcatcctgtgtacctttcatagctgtgtggtgttgtgaaagttacttaacccccctgagcctcagtttcctctcttttaaaataaagagaatagctgctatgtcttgtggctgtgaggaggaaatgttgttgatgtaactgtttagtcccgagcctgccacatggtaagccttttaaatgtcattgctattactgttatatgaaagatggactgtacaaggtaaaattgaatataaagagagatttattgatttccaatttatatcattcaagcttgcatgacacgcacccatcctattcatccatctaataaactcttaccgcagggaaatccagagggatcccttctgagcttgattcatcatctaaggtagtagttgtcaatcctatcggagccacactccttcactggcctgaaattaaattcctaggttatataatttacttataagtataatttcaaaaaacaacataattccacaactgtttttaaaattctgataaaatatgcatttcatgtgtgaaatgtgtgcataactgtgctagaaaatgtcatgaagttggccagtgctgtgcttgcatgtagagccaccaagaatggaggctacaagtgcagactgatacagctgtattaaactggtaactcaaatgtcatcagtagcattgctgtcagtgacatggtttcctggaattatgagtttccaaacgaagaaaagtacatatttccctcggtatccatgggggattggttccaggactacccacacataccaaaatctgaggatgctcaagtgcctcatataaaattggccgagtgtggtggcttacacctgtaatcccagcactttgggaggccagggtgggtggatcacttgaggtcaggagttcaagaccagcctggccaacatagtgaaaccccatctctactaaaaatataaacattagccaggcacagtggtggccgcctgtaatcccagctactcagggggctgaggcaggagaatcacttgaaccttggaggcagaggttgcagggagccaagattgcaccattgcactccagcctgggcaacaagaacaaaactccgtctcaaaataaataaataatttttaaaaataaataaataaataaaatggtgttgcatttgcatgtaacctacacactgcctcctatatactttaaattatctctagattacttacaatacctaataccatgtagatgctgtgtaaatagttgttgtactacattttttagggaatgacaagaatctataaatgtccagtactgatacaaccattctttttttttcctgaatatttttgacaaatgtggaacccacagatatggagggcaaactgtatagtcttactttgacttatatacgcagttgcaatcctggaaaattcagaatatattaaaaccatgcaaaaaattattgtgcttgaatgcacaaaggagtcagattctaggcttggatagttacagacagggttttcacctatgtgcatgcctgacgggacatgtgaatgtcagcacattgcaggactgccagcatccctagcctttgctccctaaacatcagtagtattctctaacctttgtgactgccaagatgctataaagttccaacaggccctatacagttgggatctcttgttaaaggcaaacagctggagggtgtgtggttgggagcagatggggtggcgccctcaaggactggtttctttcttagctaacacagctctttaagtcttgcagagatgggtgggtagatgctggtatgcctttctggagagaaattaggttctttgttctgatttgagtttcccctctgatatggtttggctgtgtccccacccaaaactcatcttgaattgtaactcccacaattcccatgtatcatgggagggacccagtgggaggtaattgaatcatgggagtgggtctttcccgtgctgttctcgcaatagtgaataagtctcacaagatctgatggtgtcaaaaagaggagttcccctgcacaagctctctctctctctttgcccgctgccatccatgtaagatgtgacttgctcctccttgctttctgccatgattgtgaggcctcccagccagtgtggaactgtaagttcattaaacctttttttcttcccagtctcgggtatgtctttatcagcagcgtggaaagagattaatatacccttgttctctacagaaatcttttgagaaaggaagaggcactgactatgcaagcatcaaccaagcatggccctttcctgaaaggcttcatctgtaggagggagtgcttttgatcctggctcccagcatatcagagaaagcttgcctttctctgatgcatcttaactgaggagatgccaagtttattcctcagtgtttacaaggaggcttgttcattttgacaccctttctgtggtgttgtggaaaagcaccgaacatacagagatgagccccatgaagttgaatttctgtgattcagctagcataatgtgggcactttggtttttcaaaagccatgttcagattacacacagaggtatttggttacatatatgctgagactcttgggaggtggccagttttagtctgcaggtcacaaaagggaaaaaagaagttgtacagttatggatgtcatcttgaaaaatgatgtgagaagaaacagtcttcatcttccatatctttttttcttttctaagctgggtttaatagagacatttgtgaactggcctagagggtgatcctggggtcatgtctatcactggacatgcacagagcttgagttatcttatttgttttaataattcatatcatcctttatcttccacaatgagggtggatctatagcacctccatctcctttcctcggggcaatgttatttttctagatttctctgcaaaattactttgagacaccatgagagaagaggaggaaacatataactcataatgagtaactgtccttgaaagagttcttgcatgaagaaaatagaaaacattctaattacaagtaataaaaatatcctgacaaccaaaatgcccacatgagtagtactttactttgcaagtgttagtggggaaacccacagtatttgctttttaaaaagaaatccttataagttttatttttaaaattattatcaggaaaatggacatttttctgttgatgtagagttttgtgaattttaacatgtgtgtatatttgtgcagccatccccataatcaggatacacagcatcatttcatcaacccaaataactctttcctgtaacccagttccagcaaccacttacctgttatccatccctatagttttatctttttgagaatgtcatgaaaatgatattcatgtgttgtacaatagatcatattttgaaactaacatttttttactcagcataatgtctttaagattcatcaaacttcttataaatgtcaacagtttgttcctttttattgttaggagcatttcattgtgtgggtgttccaattgttttgcgtccttgtcagtgcttggtattgccagtcattttaacttgtgctattctaatgggtttgtagttgtacatcatcatggtttccatttgcattttcctaatgactaatggtgttgaacatcctttcatatgcttatttgtcatcctgtgtcctctttgataaagtgtctctttgtatgccttttgcccattttttaaattaggggtttttttttgtttttttttttttttaccattgagttttgagagttctttattatgcatacaaattggatatgtgatttgcaaatattatctcccagtttgcagcttatcctttcattctctgaatagtgtctgtcttagggcaaaagtttttaattttgatgaattccagtttgccagttttttctttcatgtttttagtgccgtgtttaagaactcgttgcccagatcaaggtcatgggttttcttctaaaagttttaaagttttatattttacatttagatccattaagctggcttttgtacaatgtatgacattttagtcaaagtttacttatttgcttacagatgtccagttgctctgaccatttgttgaaaagactgttctttctctactgaattgctttgaacctttgtaaaaattcaatcagccatatttgtgtggatctatttctagagcctccattctgttccactgatctgcatgtttattcctttgtgaacaccaccctgtctggattactgtaactttatataagtcttaaaatctggcagtgtgagtcctcccattttattatgtttttcagaattgctttagctattcgagttcctttgcctctccatataaattttagaattacattgtctgcatctacagaaaattctgctgggacattgattagtattgcgtggaatctacaggataatttggggataattaatactttcattatgttcagtcttccaattcatgaacatagtatgtctctccaactatttaggtcttctttgatttctttcaaagaatttcagatttctctctgaattttgtaggttttacatacagatcctatacatggtttgttagatgtatacctaggtatttgatttttgaaactattataaatggcacagatttttaaatttcagtttttaattggccactgctagttgtattaatttctatggtgactgtaacaaatttctacaaatttggtgctcaaaataacagaaatgtattctctcacagttcaagaggtcagaagtccataattagttttgagccaaaatcaaggtgtcagttagcagggtcgtgttcttttcagaagcactagaggagcatctgttctttgctgcttctagcttctggtggctgccagcatttcttggcttgtaactgcatcattccagtctcttctctgtcttcacattgcctctcttctgtgtgttggcccttcctctgcctctgtttttataaggaccacttgtgatgccatagagggcccacttacataatctaggatactattctcatctcaaggatcttaatcacatctgcaaaaactttacacagggtaattctggcctcataaaataaaatgagacctgttccctcctcttctattttctggaagtgattgtggatgttttgtgttatttctcctttgtgtgtttcatagaatttaccagtgtaaacatttggacctagtgctgctgtttttcaggtttttgattacaaattaaatgtccttcatagttatatgactatccagattacctgtttcggctggggcaagttttagtagtttgtagtttttgagaaattggtccattttatctaagttgtcaaatgtatatgcatagagttgttcatagcattctgttgttattcttatattgtctgcagtatctatagtcatgtcttctttttctttactgttaatttgtgctttccctcttttttctttatcagtcttgctagtgagttattagatcttttcaaagaattggcttttgggtttattggttttccttattgttttttctgttttcagtttcattaattgttttgtcctaattatttccttccttttgcttgccttgggtttatttggctcttctttttttctagattcttaaagttgaagctgaaattgtttgaaactttttttcttattgaatataaacatgtaaagctatgtatttccttttaagcatattttagctgcattgaacaaattttgatatgttgcattttcattttcatttagtttaaaatattttctaatattctttgaatcttaccctttgacccagcgattgtttagaaggatcttatttactttctaagtgttttgaaatttccctatttttgatattggtttctagcttaattccattatggtctagaaatatgcttcgtgtaatgtcaattatttaggtttgttaaggttggctttatgatccatgatatagtcaatcttggtgaatgtttagttatttggatattgggttttccttaaagggagccatacttgaaactggctgttggcagatttactcaagactcttcctggaagattgtcactcacagccaattctttcctttgtctagagcatccaggatgtgaggagtgatgacgaggattatgaagaggaagaggaagaggaagaagaagaggctaccaaaggcaaagagatggattgtttaaagaacggcctcagggctgagaggcacctcattcccaatggccagcatggccattagctggaagcctacaggactcccatggcacagcatgctgcaagtactgttggcagcctggcttccaggccccacaccgaccccacattctgcccttccctctttctcaccaccgccttccctcccacctaagatgtgtttaccaaaatgttgttaacttgtgttaaaatgttaaatataagcatgcccatggatttttactgcagttaggactcagactggtcaaagatttcaaagatttctccacagaaccgtctcagttctaattgcactccctcatgcatgtcactttctcaggggctcgctttgttatagaccctttcgcctcgccaccttgcctgtcctcaggacgctttcacaggtgctaagtgatctcatttttcccaggtgtgtttggccacaaagagcagcttctttctcaaaatgagttagaagtggcagtgggacaggagcggaaggaccacaccaggagacacttccatcctgaagcttaggtgcctcatctccacagggcggtggcagtccctgcctgccaccccacagggttacagcaaggattaagtgagatcacagaagtttaagtacacactgtcaaccgtggggtcatcgtgaaccaacccactttgcactgtttgggagacagaaacctggctaaacatggcactgcaatgggcctgaacaaaaggcagaatctttaaaaattcctcttaaatgactctggagatacctggaaatgaaagtgccaagaaaggtgttccattttatttgctaactatttatgcattagctccccaagggtcattctcagattctcctggaattcttctccctcaggacccatggttcaaggaaggaagcttaggccctgttccttcctgtcctttgctggtctttcccttttttcctttctaggagggaagcttctgtgctgctgccctgagcccttccttcaggccagcacagtacctggggacctccacgggggaatgggatccaggccaggttgcttgctgagcctcatcacccaggaggcctgagcctctggggagggcacgcatgtacactgccagacccaggggagatcttgggaacagaggatgctacgtgatttcctctggcttccaacccaatcagcctgcatcacagtgaaacacaacacaaaaggccataaaaggcatacccctgagaaatgtttaagggcaggtgctagagtcagtgccagctccctgggaggagggatagggacgggcagatcagtagccagcttgtcctcaccctccggaagggagcaccggagaagacttgcacacgtccctgcctcccttgcggccttgtcaccagagggacacatctcctgggcacaatgtgcagggctgacctgggagacttctcaggtggctgctggctgaggagaggccaggccttcccaaggaagaccctgagtaaaatctgcatctgtcctcaccacctggcacagtctctcataacggtcagattttgtatgttcatcctatttattcaggggctcgtactagaaagccacaggagaggtcggcttgtagggactggaaaatcagccccaagcagagcagctgcagggcccctggagccggaaggacactgcacagaacagactgcgttattgttatttttaaataaaaatatacatttgaaaccttaaggctaaacaaaaataaacaaaaaatcctttagaattctttccacaacaatatctctttctgagaaattgttacaaacaaggtcagattttctctgtataacatttgcttttatgaggacaatatcatatgcattatatgcataatatgatattataaatcaaaatgcctgcacccactttagggtatagctattgacttattattaatattatattattattattttgctggaagaaggtcacactaagatataattttttatgttttcagttaacggtatgctttcttctttgcttatttggtttttgtctctgtaccaaatatcttcttgcttaaggtagaaaagtatttgtttacctctatctccagttttttttcttatttgaatgttgaaggtaaaattgatataccaattttaactatttctgatacagctgaaagcactaaactacttcataagaagtagatactcatttttgtaacactatttagggcttttgtggttaattttaaaggaaaccactctttctacaggaaacaagggctcaggattcttcagatgaccttataaaaatgcagtccacagtgctatcaatattgtaacagtaatgactacaataaagccaaaagtccagtgtacctggtgattgagtagattcagcacacacattgcttggcttcttagggataataacaggtctccctgtgtagtggaaataaagatttgccattcctccggaagggccatgccaggaatcagggaagcagtgaggagaaggaagccaggttgggatattcgggctgctgcgtttgcggtgtcagacaccagataagaggagcctggctgacatggggagccccttgcctgattggggtgagcctctgggctatgtacggtggaaccagccagccagcctgggggctggagcctaaggagagctcggcatctgcaccctgtgcaggaaccactgaagtgctaagaaaggggactgattctaaaggtgttttctcagcctcattttctgtatttacctttcaaaggtgtaggaggaaacagagtctagactgtccatcagaatgacctatggagctttaaaaacaaacgcaccttgcctgtctcctgctccacgttttgattcaatatttctggagtgagcagcaaaaatcttcattttaacggagtgccatgtatttctgaagagcagtcaagattctgtgtgccttcctctggttttagtcctagctgcagtttcatatgctaagagctgggaaaatgcaatggtacagaatatttaatccaaaataaaagaagaaaaggaaacacagaacaagcaagatgaatcgcaaactcatgttaagatggtgagtaggtagatttcagttcacatttaccagtaattataccaagtgtaaaaataaagagagtgccaggctcgatttttaaaaatctcaattatacggtgcttacaagagatacactataaaaaagtgttgaaagtaaaaacatggacaaatatataccatgcaaactccactcctcccccaaaaaacgctggcatagttatatcaatatcagataaaggaaaggagaactagtggatagtaagaggaatgtttaatgctaatgaaaggggctaggtgcggtggctcacgcctgcaatcccagcactttgtgaggccgaggtgggcggatcacgaggtcaggagatggagaccatcctggctaacacggtgaaaccccgtctctactaaaaatataaaacattagccgggcgtggtgggaggcgcctgtagtcccagctactcgggaggctgaggcgggagaatggcgtgaacctgggaggcagagcttgcagtgagccgagattgcgccactgcactccagcctgggcgacagaaccagactccatctcaaaaaaaaaaaaaaaaaaaaaaatttaaatctgtatacacctaataatatagcttcaaaatatatgaagaaaaatttcacagacttaaagggagtaacaaattcataatcctgtttgggcggtttttaatacatctctcagtatctgatagaacaagaagacaaaaaaaaaaacaaaaaaaccaataggaatatagaagatttgaacaatgccattaacaaaatccacctagttgatgtatatatagaacactgcccccaacaactgcagaatttacatttgtttcaagtgcatatagaacatttacccaaataggccatatactggcctttaaggcaatttccaaaacatttcaaaggtttaaaatcacatggaatatgattacagataacagtgaaattaaactagaaatctataacaaaaagataaatggaaaaatctccacatatttttaaattaagcaatgcacttctaaataacctgtagatcaaagaagaaatggaaataaaacattttaaactgaattatagtaaaaaatgtgtgggatgcaactaataagaaatttagagaaaaaattatattaaaagcttttataagtaaagatagaggctgacaaaatcagttgtctaaatatatcaaaatataaagaggaaaattagtaacatggaaaacataatagctcagagtatcaaataaaaaaagctggtttcttaaagtaaaaaattt

SEQ ID NO: 12 - DNA, 792 bp, Homo sapiens
aagcagcccggcccggcattttacgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcattgaaggagaaggagaaggcctcctggagcagcctctccatggatgagaaagtcgagtgtgggtattgaagggacccacaggcgcgcccagcagctctcggaagcgttgtatcgcattaagttcaaggagagctttgctgagatgaacaggggctcgaacgagtggaagacggttgtgggcggtgccatgttcttcatcggtttcaccgcgctcgttatcatgtggcagaagcactatgggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaaacaaaaaa

SEQ ID NO: 13 - DNA, 523 bp, Homo sapiens
cggaagttttgctgctagtcgcggacgcaatggcttcaaggttacttcgcggagctggaacgctggccgcgcaggccctgagggctcgcggccccagtggcgcggccgcgatgcgctccatggcatctggaggtggtgttcccactgatgaagagcaggcgactgggttggagagggagatcatgctggctgcaaagaagggactggacccatacaatgtactggccccaaagggagcttcaggcaccagggaagaccctaatttagtcccctccatctccaacaagagaatagtaggctgcatctgtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccataaaaaaaaaaaaaaaaaaa

SEQ ID NO: 14 - DNA, 921 bp, Homo sapiens
tgtgagctcctagaagtcagctttttcacttttacccaagccaaacggttattcgcgtaaggttggttataattaaaatgtcggtttgtgcacatggtttgggactctgtgtatgagtacgactaatatcttcaatttactaagaagataaagaggtcgataaataaggaggtcaagcccgttttgcaaggtcacacaggaaagaagcagaccacgaaatgaacttcggctgtcacctgcggtgggcgcactagaggtcttttgaactccttcggctaccgtcgccgcgttctcgctgtgcactcttattctgcgcctgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaatactttggacagtaagtctttctcagttcttaatgataatgcagggcacttactagcataagaattggtttgggatttaactgtttatgaagctaacttgatttccgtgttttgttaaaatttcattgttctagcacatctttaactgtgatagtt

SEQ ID NO: 15 - DNA, 910 bp, Homo sapiens
gaggtcagagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgagccaaaaaaaaaaaaaaa

SEQ ID NO: 16 - DNA, 5598 bp, Homo sapiens
agagccactgaggcctgagcgagagccgacggcgggcgggcgcagctgctgccggagcgccggcgcgtgctggtgggccacacacctttcctcctcttcactcgcgagccctcggacatggtggcccccggctccgtgaccagccggctgggctcggtattccccttcctgctagtcctggtggatctgcagtacgaaggtgctgaatgtggagtaaatgcagatgttgagaaacatcttgaattgggcaagaaattacttgcagctggacagctagctgatgctttatctcagtttcatgctgccgtagatggtgaccctgataactatattgcttattatcggagggctactgtctttttagctatgggcaaatcaaaagctgcacttcctgatttaactaaagtgattcaattgaagatggacttcactgcagcaagattacagagaggtcacttattactcaaacaaggaaaacttgatgaagcagaagatgattttaaaaaagtgctcaaatctaatccaagtgaaaatgaagaaaaggaagcacagtctcaacttataaaatctgatgaaatgcagcgtttgcgttcacaagcacttaacgcttttggaagtggagattatactgctgctatagccttccttgataagattttagaggtttgtgtttgggatgcagaactacgggaacttcgagctgaatgttttataaaagaaggagaacctaggaaagctataagtgacttaaaagctgcgtcaaagttgaagaatgataatactgaagcgttttataaaataagcacactgtactaccaactaggagaccacgaactgtccctcagtgaagttcgggaatgtcttaaacttgaccaggatcataaaaggtgttttgcacactataaacaagtaaagaaacttaataagctgattgagtcagctgaagagctcatcagagatggcagatacacagatgctaccagcaaatatgaatctgtcatgaaaacagagccaagcattgctgaatatacagttcgttcaaaggagaggatttgccactgcttttctaaggacgagaagcctgttgaagctattagggtttgttctgaagttttacagatggaacctgacaatgtgaatgccctgaaagatcgagcagaggcctatttgatagaggaaatgtatgatgaagctattcaggattatgaaactgctcaggaacacaatgaaaatgatcagcagattcgagaaggtctagagaaagcacaaagattattgaaacagtcgcagaaacgagattattataaaatcttgggagtaaaaagaaatgccaaaaagcaagaaattattaaagcataccgaaaattagcactgcagtggcacccagataacttccagaatgaagaagaaaagaaaaaagctgagaaaaagttcattgatatagcagctgctaaagaagtcctctctgatccagaaatgagaaagaagtttgacgacggagaagatcctttggatgcagagagccagcaaggaggcggcggcaaccctttccacagaagctggaactcatggcaagggttcaatcccttcagctcaggcggaccatttagatttaaattccacttcaattaaaccaactgtttttctgctcttcttaatttttttaaagattaaaaacaaagaaatcttgttccgggaccctaatgaaaaaaaatttcaaatcttttcagtttgtccatgaccaaagagttgctttaataggaaaaaatctgttcttatccctgtcagatttatggttaatgggtttgcaacggcaaggaggcaaggaatggttctatttctgacagagcagcctgcatctgctttatgctgtctggagggaagtggtctgaggcaggctcacccgtggaagtgctcacgtattctgtattatttttctacactggagctgagattcttctcttcacagccttgcagagtaagtcagtgcctacaagtgtaagaaggagctgtaatcttcatgaggatggttatacttcagtattcttaaagagaacatgaacatttttgagctgtatgttcttagggacaactgtgcttcgatgtggtcagtctcgtcacttgtgagtagctgtgaaatctttagtgtgcatgtgtttgcacctctgtggtctgtcaacgtggctgtcactgaaggagcaagagaccatcttttaggaaccctgccaccaaataataatatatccaggcttagactttggattaatgttaaatgtacatttttttggttcagtacctgaagaagaatactgaaacttgaatctataaattcctatggacccttttaatattaaacacaacaaattaaaagttgttataggtaaaataagttcagataaaatagtggtggtatttaaaataatattgctgaagtgcagattgaaatactttttaaacaactgaagttctgagtttttatagggaatttcatgtaacaagactggtttagaaacgtaaagttgcgcagtcaacataaataaatacagaatgccatgttctccacttctaagtaaagacagtgggcagcttctgtttctccttctatcaaggcttcaccctatcttaaaggtctgtggtgcctcccacgtgggacctgtctgctggtatgtgttaaacagcagaccggcccttctaccagatcttgatgcctctgattttctcctgcctacaagaaaatacaggcaaggttagtcaggtctggctatatttccactgttgtttcatttaataagatggcatctcctcttgagatatgttcttcttaccttttaagaagatactatttaagaagtgaactattcagtctttgtatactgaatgctttttccctaaaaaatgttaatcaagaatattgaatatttatggcactcttgatgctgcatttgaaagctgaaggaattactttagatagataggaattgctacctttattctggaaaggttttgtttctgcctcaaagcattttgaagtgttttaaccattaaagggtctaatttttttttcttaatgaaatcaagcattttaattcactgtgggaggcatcctgaccacggacatccataacagcaaagcacaaatcgttttcgtctgtagtcatatcctgaaacataggtggacaaatttttaactgagagacaaaaatcacatagttgaattgagcagaacacttaagtgctttctgcatctatttaggagtctatttcttaccaataaacttgacaacgcatttggaaaactagtgaacaccttacagctttcattttgctttaatgtttcaattcaagccggtgtaaaaataatttccaaggcatttctgtttattctttagtaatctcactactggctatgtcagcaatatctttttcaatctggttccttttgtatatgatgtcactgtgacctctttgaaatatagtgatggcttttacctactttgaaaagaattttcacatagagtcagaaaaaaaaggaaatatcaaatcacttgcctttccacttggagagcacgacagttgccaacaacaaggggtcaagggccgcacaggagatgtgtgggggcctggccacctcccacctgctgcccagaggcttgtttgcattttcattttttctccacttgtaacaaccatagtttcagctcctaaattcttatcatggatttacttagtcatcttaactgacctgcagttacttgcctgttttcagtgaagagagagaagcagctctggtgccacatgccagtgccatggagggaaatgaattctctgcaatctgttgtttcgctgattcatgaagaaagtaacaactgttgagtttcagccttgatggctgtcggcagttttctggtgtccacccaaacggagagacagtcactcctgcttaccctaatgtgtgactgagaagcagcctgggtgtgtaaagagatagtcattccccctgcctgtctcactgtagggtagcattatccactgtaaaaccatactactttcattttcccttggggactacaggtgccaggtaacctttttttttttttttttttttttttgagacagaatcttgctctgttgcccaggctggagtgcagggacacctcccgggttcaagcagttctcctgcctcagcctccaagtagctgggactataggcacgcaccaccatgcctggctaatttttgtatttttagtagaaatggggtttcactgtgttagccaggatggtcttgatctcctgaccttgtgatctgcccgccttggccttccaaagtgttgggattacaggcgtgagccactgcgcctggccatcaggtaacctttatggctctttcaggaaaagtgaaatcagagaggcgtaccctagccacagctgttgtattctgctcttctttcctttttggtgagcttcatgggtggagttatcagtggtctgtactttgtggatattttgcccagcaggaagtattagacacatcagtctagaagcattgtgaaaaggttccaaaacgggagacaaaatttaattcattcctcagttctgaaagtttgtgctttcttaccatgaatagatgaaaacttgaaaaaaatcttgacagtttactaatgtgaatcagatgtaacgtactactaattctacaatgcctttctctttagtcagtattaaaaatcttttttaaagtattggtatgaaaacaaatttttgttgccctgataatggaattttaaaactacccacagtttaagagaaaacataacttggtaaaaaaggtagccaataaaaccacaatttgaaattgataccattttctactcacaatggatgatgaaaaatttcacctttaaatgggtcagaagttgtctttgacatttaccatgaaaaaactacataaaatggctccctggtgaggttacagacacggccctggtgatgggcgttgcaaagttttcactgagcacacagcaatggtatcacctagagaagttcacgcaactttgttgaatgtagttgacttttccaaatttataaaggaaggaagaaggcaaatgttaatttgccaacaacgaatatcctttttctaaatcagatcattccttttttgttagtggcagtttatcctgtaatttcaaatgacgttaagaggtgggattatttgggggttttttttgtttgtttacagatgatctcatttgctgaatgattgatttaagagtaaaattagccactgcgtggctttgtgtatagtaaccggttttgttgcacttgtctgtggctgaaacacttacctgcagtggaaagccgagcaaggaggaggtaaacattggagatgtttgtgaaaatattactcttgctgtgaggttttagtttgttttgaatgagaaaagactaagtaacttaatccatctcaatgtagtgttttaataaaaaaggaacctaatatttgaaatgggtctcagacatgtctacaaatatgggtactatttttatgcccgtgtattttcacatttaataaaaatatttatggtcatatcagtataaaaaaa

SEQ ID NO: 17 - DNA, 23182 bp, Homo sapiens
tgccctgtcccaggatggacagcacttcatgagtgctcagtgcagggacacagaggcctggacatgttggtccaacctggaaggttcattccagctccagagctccctgtaagatccagcaaggctgtcctggagcctacccggcagcgtgcttctccctctgccctccctggcttcttcccctgtccctcctttcccttcccagtactggtcctgagagcatgctaaacttcctccccgctaatctgcatctcagagtctacttcctgaaaccaagagggagggcagcacatccccaccccaggcccaggaaacgcagaggtgcaggtggggagaagacgccttcccctcagcagggctggatcccctgactctttcctcacctcggagctcttgattctcctccaggcagcgctggagggtctcaggagcgccctgttctgaaggcaggtgcagcatggctggcttccccagaggagactcttcgcccagtacgtcctgatctgctgccgggccaccactgggctgcaccatctcacacagttggctcttccagaggtgcctattcatccaacagggcaagggctgaaagagaaaggcagcaggggagtcacaggagacccacatccttacccagcagaaaaagcctatgagttctggggctacattttaaacagaatgctgataattcacctagtgtatcaggatgctaaagtgggttttcagtctaaggggtagcagatactcccattccaaagggaggtgctggaccacccatgtgggacttgaaaaggcctagctccaggctggaaatagaagaatttcaccagagatgggagagtcgggacaagactgtttgtggagggagatgtcagtatgctgggaatcctgatcccctacacacctccaagcaggagaagtggagggtaccggcccctcatccagtgtagtgggctgaatggtagccccccgaaaagatatgcccatgttctaacccctgaaacatatgtgattcgggaaaagggtctttgcagatgtaggatctcaagatgagatcattctgggtgacgtgggtgggccctaaatccaacaacgtgtctttatgagagacagaagagagaagccagagggagacgcaaggggaggaggccatgtcgggactgcctcggagactggagtgaggcagccacaagcccaggaataaatggggcagaagcttgggagaggcaagggaggattgccctcttagagcctttgagggtgtgtgcttgctaaccctttggttttggacttctagtctccagaactgtgagattaaaatgtctggccgggcgcagtggctcacacctgtaatcccagcactttgggaggccgaggcgggccaatcatgaggtcaggagatcgagaccagcctggctaacacggtgaaaccctgcctctactaaaaaaaaaaaaaaaaattgccggtcacggtggctcacgcctgtaatcccagcactttgggaggccgacacgggtggatcatgaggtcaggagattgagaccatcctggctaacacagtgaaaccctgtctctactaaaaatacaaaaaattagccaggcatggtagcgggcgcctgtagccccagctacccaggaggctgaggcaggagaatggcgtgaacccgggaggcaggagaatggcgtgaacccgggatcgcgccactgcactccagcctgggcaacagagcgagactccatctcaaaaaaaaaaaatacaaaaaattagcagagtgtggtgacacgcgcctgtagtcccagctactcgggaggccgaagcaagagaatcgcttgaacccaggaggcggacgttgcagtgagctgagattgtgccactgcactccacccttggctttcagaacagccccttctcctggtttcctccctatcttgctggctactcctgcccaggcactctcactgggttcccatccttcatgttgggctgccccagggctctgtcctaggacatcttcttctctgtaacttcattcactcccacaggaattctgtccagtctcatgccttgaactccaatcttgatgcttaattagacctcttttctaaactccacattcatttatcaaactcgacatttctacttggttatctagtagccttctcaaaacgaacctctctaagacctccgacagtccccaaaacccagatctacccaaggccttctttgttatcagctgatggcgaatccatcctccagctgtcaaaagtcttttttgattctctctctctctctcacacacacacacacacatacacacacacacacacacacacacaagagcacatctaatccatcaagaaatcctgttaaaatgtatcccccaaccgatctgatcacactgagcaattaacattaactattttaggtgtcataatgatattgtggttgtttttcagagtcctgtcttagagagaggcacacttaaatgtttaaagatgatgtctgaattcacctccaaataatgggaaaactcctaggtatataccggagagaaatgaaaacacatgtgtccacatgaatgcttgtagcagcattactcatagcagccagagagtggaaacaacccaaatgtccatcaactatgaataaacaaaatctagtacatccacatgctataacatgaacaaatcttgaaaatatgctgagaaataaacaagtcacaaaagattaaacattgtatgagtctatttatataagatgtctacaacaggcaaatccacagagacataaagtggattaaagattgctggggagtgccacttagggctgaggggaagataagctgagctaaagggtatggggtttctttgaggggtgacgaaaatgtcctgtgaatatacatacaacaaaccattgaattgtacactttaaatggatgaactgtgtgacatgctaatgatatctcaagctgttattgaaaataatagtggtggccaggcatggtggttcacacctgtaatcccagcactttgggaggtcatggcaagtggatcacttgaggtcaggaattcaagaccagcctggccaacatgacaaaaccctgtatttaccaaaaatacaaaaaaaaaaaaaatagctgggagtgatggtgcatgcctgtaatcccagctatttgggaagctgaggcaggagaatcgctcaaacctgggagatggaggttgcggtgagccaagatcgtgccactgcactccattctgggcgacagagtgagactgggtctcaaaaaaagaggccgggcgcggtggctcatgcctgtaatcccagcactttgggaggccgaggcgggcggatgacaaggtcaagagatcaagaccatcctggccaacatgatgaaaccccatctctactaaaaatacaaaaattagctgggcgtggtggtgcacaactgtagtcccagcggctgaggcagaagaatcgcttgaatccaggaggcggaagttgcagtgggtggagatcacaccactgcactccagcctggtgacagagcgagattctgtctcaaaaaaaaaaaaaaaagaaagaaagaaagaaaaagaaataaaataataatgggagaggattgcgagggatataaacaaaattagtcagaagttgataccttcaattgttgaagttggtagctgtgaatgtaagatttactatactggccgagcgcagtggctcacacctgtaatcccagcactttgggagtctgaggcaggcagatcacctgaggtcaggagttcaagaccagactggccaacatatagtgaaaccccgtctctactaaaaatacaaaaattagctgggcgtagtggcgcacgcctgcagtcccagctacctgggaagctgaggcaggagaatcgcttgaacccaggaggaggaggttagagtgagctgagatcatgccactgcactccagcctgggcgacagagcgagactccatctctcaaaaacaaacaaaccaaaaagatttactatactcatttttctactttcgtacatttttgaaatttccaataataaaatgctcaaagcactgtctctgagctggattactgcaattacctcttaccacgccacccttcttttacccttgcccactatggtctgttctccccaccactgctagaacgatcagtgtaagacgtaattccgatcacattcctcctctactgagaaccctaccatggatccccgttgccttctgcgtaaaagccaatctccctacaacggcctacaaggccctgtaccatcgggttccccatcccttcctctccaactgtgctcccctccctcactctgctccagctatagtgacctccgtgctattcctctaatgtgccaggagagcccattcattctcagatcacagaaacagtatgacgataggcagatgttgtcttgcaaaacgagcaaacaggcatatgaaatcagatacctagctgccaaactatatgtgaggcatttccgaagaatttaacgacctcgatagagcgcagtcaagtttggtgaacagaatatgtctctgaactagaggagtcctcacacaaggagtagggtcagaccccgcagtggaggaggagggaggagtagaaacagtccagctcgccgcccaagtaacctgggtcctgaatcggcccgccttggccagtgctccagaagcgcggagcaggaacgggctggggcccaaaaaagaggggggagcctgaacgtccgggggaagtttcggaggcggcggaacgcccacggatggaaccctgtctttggggaaaaggaccacacctgtcagcagagtccgtcagacgtgagaagggtgggagcggcggactgtgaacgctggtagggccccggcgctccgagaaagtcccagtttcgcggtcgcccttccctaccacgcttccggcttccggtgtcatagctgtgggatccggaagtaaaaacacaagccccgcccccgagaactcgggaagccggcgagaagtgtgaggccgcggtagggccgcatcccgctccggagagaagtctgagtccgccaggctctgcaggcccgcggaagctcggtaatgataagcacgccggccactttgcagggcgtcaccgcctacacgccccctcgtctctcggacggcggcgtctagcctcggggcgctcggccgccccgccctctccgggggaggaatcaagaagagactgcccaatagggccggcttgacccgcgaacaggcgagggttcccgggggagtggcgcggcagaaggccccgcccaggagccgagggacagcccagaggaggcgtggccacgctgccggcggaagtggagccctccgcgagcgcgcgaggccgccggggcaggcggggaaaccggacagtaggggcggggccgggccggcgatggggatgcgggagcactacgcggagctgcacccgtgcccgccggaattggggatgcagagcagcggcagcgggtatggcaggcagccggcgggccggcctccagcgcaggtgcccgagaggcaggggctggcctgggatgcgcgcgcacctgccctcgccccgccccgcccgcacgaggggtggtggccgaggccccgccccgcacgcctcgcctgaggcgggtccgctcagcccaggcgcccgcccccgcccccgccgattaaatgggccggcggggctcagcccccggaaacggtcgtacacttcggggctgcgagcgcggagggcgacgacgacgaagcgcaggtaaccggccgggcgggcgccgcgcaggcggaggagcgtactgtcccgcgctgcgccgcgcggcggtaaaatacacgctgtttgttgtgcttgagaaccgagcagaatcgagagggtcttaaccaatccctttataccccgcacctcctctcttgagcccctgagaccccgagagcgaaggggacttgccgaccggggtcacccagcttggcaaggggagggctggagctgaactccagcatctgcaccatctcccatgctccaggtcattgtggagttcccgctacagtcgggaatgagatggtcctgggcacgcagttccatgccccacaaggattttactcggttgtccagaattgatgctgtagtcggaatacaccaatgctttgagtaattttgtaatgtacaccctgaatgaaggctgcctaggagagagtggctggagcccagagccagcagtttctaacccatcaaccactccccaatgcccagccgttcacaaggagtgatttgggcaatcaggtgtcaccctggtgtgagaccccagaggaactctcaagaaaggggctaacttctcaatgctctcctgttcttctgccttgttaacgagcctttcttccaccagacagcgtcatggcagagcaggtggccctgagccggacccaggtgtgcgggatcctgcgggaagagcttttccagggcgatgccttccatcagtcggatacacacatattcatcatcatgggtgcatcggtgagtatctcccaggccccaatcttaaaagccaggaagtgcctgctccatgcctcagcttttccaactaattgttgcagggccccacaggctctgctaagttgagctcctcctcccgctcctgctagtgcgccaggatcatcccggctctacctggtgtgcatatgcacttgcaagacttttttttttttttttttttggagacggagttttgctctggtcgcccaggatggggtgcagtggcgccatcttggctcactgcaacctcggcctcctgggttcaagcgattctcctgcctcagccccccaagtagctgagattacaggcatgcaccaccacacccggctaatttttgtattgttagtagagacggagtttcaccatgttgaccaggctggtctcaaactcctgacctcaagtgatccgcccgcctcggcctcccaaagtgctgggatgacaggcatgagccaccacgcccggctgcaggacgtttctgaaccctgtgcctagccgctgaatgtagcccttaatcctggagttgcaggctctttagggactgtctagatggacttcttggggaaaacagggaatgctattcattctgtagttttttcagacctgttcatgccttaacaaatgagttccaaaggcaggatctgaggcctgatctctgcctcttcactaacacttcaagttccgtcgatacaaacacttagcttttctttgaacactgtctctttgcctcaatttcgaaagcctaccaaggagctctgcctcaccccacctggccccaattgtccagcttgtagaaccgccattctgcactcataggaaagacaaaagaatagtatagcatgaggatttccatgggaggggagggaggggtggtcctaggacagccatcgcccgagactagagcaccctcccctgtgtcccatggggcagtgagactgtgcaggggctggtggaacaagggcttcatctcaaattacacgtggtctcagttttcacttttaaccctggatgcactcaagaatctctctgctcattactgtatgaccatctttgccattaacttaccttgtaaccttgagcaggagctctatcaaaactagttagttcttccacatcgtgcgcccctcagtgctggctgagctcagtggttctttgttcacatagaacaacgcgctgtcacactttgtcaaacctactccttgacacctttgtacttctgatcagaacttagaaaaggagagccaaaagggaatgaggaggcagccgagggagaagggctctgccagtggcagagtaaggaggggccattgtcctctgactccccataagcctgagacccaggagaggtaccaggtggagcccacagtagattgggcttggcctcagccccagccccagcctggtcccctcagaagagccatacctggccgggcacggtggctcacgcctgtattcccagcactttgggaggccgaggcaggtggatcgcctgaggtcaggagtttgacaccagcctggccaacatggcgaaacccagtctctacttaaaatacaaaaattggctgggcgcagtggctcacatctgtaatcccagcactttggggggccaaggtgggcagatcacaaggtcaagagatcgagaccatcctggccaacatggtgaaaccccatctctactaaaaatacaaaaattagctgggcgtggtggtgcgtgcctgtagtcccagctactcagtaggctgaggcagtagaatcgcttgaatcagggagtcagaggttgcagtgagctgagatcgcgccactgcactccagcctggcgacagagcgagactctgtctcaaaacaaaacaaaacaaaaaggccgggcgcagtggctcacgtctgtaatcccagcactttgggaggctgaagcgggtggatcatgaggtcaggagattgagaccatcctggctaacatggtgaaatcccgtctctactaaataaaaaattagccaggcctggtgtgggcacctgtagtccagctactcaggaggctgaggcaggagaaaggcgtgaactcgggaggcggagcttgcagtgagcagaaatcgcaacactgcattccagcctgggtgacagagtgagactccatctcaaaaaaaaaaaaaaaataacaaaaattagttaggtgtagtggcacccatctgtaatcccagctacttgggaggctgaggcaggaaaatcgcttgaacccaggaggtggaggttgcagtgagctgagatggcaccattgcactccatcctgggtgacggagtgagtgagactccatctcaaaaaaataaaaataaaaagagccatacctgcatcagccacaaaccttaacagccaggactctgaccgttaaacccttagtccaagaagcagactggaggagaaggtaactgaggttgctttctccatccccaccccatgctgtcacaaggcactgcaacagagcaacccaggccacaatgatagcttatgactcctggccttcagctcttattagacacctcattgagagcatccaagcttgctgtgtgagttggagcaagtgtcttccttttcctgaacctcagcatttcgtgtagcaaatgacagcttttgaaacgagggcccagggtccttaggcttttccaagctgattttgtcatttcactgcctccgcctgtggccagcttcgggttgggcaactttgttttgttgaaatcagtagggttcccctttgctctcctctgttctgagagtgacaacctgaggctttcaaagcagaaataggaagtgccagctccagcactgtgggtaggggacaaggggtcctctctctgaagagcctcgtggtttgttttttcctcttcctgctgtgggggagatgggaggtggcgtgctcaggcagcacctggaacagctccggctcccaggcttcttccacgcctgatgcctcactcggtgcgggaggtaggcagggtggcacttgagggcacgtgatcctagaatctgctgttccaggaaagcagcccattctccgttcattgagcagacagcgattgggtacttctgggccacagcagccagtccctgccctcctcatgggacctatgtgctattgcggccagggaaccacggcaagtaagcagaccagcaagagttcaggctgacgtgtgtttcagaagatacacatgggccctgtgtccccagtcccccaaagcgcatagatcccacaaagagggccgggagagcacaaacacagaaggaagagcaaatgcccggagccccgagttgggaacaagctcagcatgacctagaaactgaaagcaggcaagtggctggcagacccacagcctgggcaagcaggacaccctggggcaggctggacccacgtggccttcctctgtcccttcctcctccctggccagcttacctcacacttgcccacacacccagcttccttcctgggggccctgatggcacctcagagttaccaagtgggccacttcctgccttctcaggactcccacccctaccagaaagggagccgaggtacttactgcccccttccagaaagctctggccttgtagactagtgtgcgcctggaacagcatctttccccacctgatgggacctcgatgatgctggagagcttcacagggagtgaggggaagagactgggattgatagtctgcggggtcctcacttctctgggccttagtttccccacctggatcacaagggccatgggcttgatgggcgttcaggacgcatcccaatgatgggcctgtgggagggatgacccagcggcccccgcctcccctttcctcagaacatttctgggctgacttccccattggtctgataagattcttgctgtgtcatgatgatgttggcactcccccaaagccccggtgactcatgagcccccgggtatagcagggaggcccttttgttggtttttcagctgaactaactcagcagcccccaggttctctggccccagtggccaggaaccagctgggcccctgccaaggcccagggctccacccagggagtctgggcaggtccttaaccccagtgacccttggggatgggatggcccacccccgctggccctccagcaggcatcgtgctctaccatgaaaccctcatgccaagacaagggctgcagcgatttcggtttataaaacagacaggtcatggcccaggtccctttgccctggcctagccagatgttggtggctagagatcttcatcatgccctgcttctactaagtcaccttgtgtccttgggcagatccctcccctgctgtggtcctcaggaaagaggagggcgtggggaagatgagaagctcccaactgcttttcactaaggaccccttgaattgcccccacccacatggcacgagtagactcttgaccaagctgtcaggtttcccgatgtcttcccatgtttgttcctccagaaagtcccactagagcatcgcagccagctgggagggcagggctacccctgagtcctgaggagagcagctcagtccggctcagctcagcttagctccctgtcaccatgggagagagcggcctgccttaccccacccctactgtccgtcttacctcacctcgcctctcaggtgacttggagcccagcagacggtcggtcggttgcagggcctgagctgaaacaaggtgagccggttcaatctctagttaatcccaaagggagcagcaggaacaaacggcctggagcgtggggttgctgtgactcagcagaccagtcccctgccaccagtacctttctggagtctgtcccgatgcctcccagtcttccggaatttggtcatgagcaaacatgacctgctttgagtgaggcttagaggtatttgcaggctgtggttctttccgtttatttcagggtccagttagttcccagtaagctgaccctttctgtgtggggccagccgtgagttgatgtgacatgggcaacgttcccctccccagccccactgatggcaggtgctgtgaggagctgagtagaggagctcctaccccagggcgaggggttgtctgctggactttgaagggtgcagcagtgagaggtccgtgtcgctgtagtcctggcaccgagctcacctgaggagcatcagaagtggagcagggcccctgaagagcgcaagcacacaaggcacccacaccatagcagttgccctcctggaagccctgtggtggcttcctaactgcctggctctgggtgagggcgtttgacctggtggcatggcccccattctgtaatggtttgtagaaatggacccatccatggttgcagtgcctgattgcttcgaagagcatgtgttttttttttttttttttcgtgacatggagtcttgctgtcacccaggctggagtttggtggcgcaatcttggctcactgcaacctccgtctcctggattcaagtgattctcctgccttagcctcctgagtagctgggattccaggtgcctgccaccacatccagctaatttttgttttttcttttttttgagatggagtcttgctctttcaccaggctggagtacagtggcgcaatcttggctcactgcaatctccacctgcgaggttcaagcaattcccctgcctcagcctcccgagtagctgggactacaggcgcgcaccaccacatccagctaattttttgtattttagtagaaacggggtctcaccatgttggccaggatggtctcaatctcctgacctcgtgatccacccacctcaacctcccaaagtgctaggattacaggcatgagccaccgcgcctggcctgtatttttagtagagacggggtttcaccatgtttgccaggctggtctcgaactcctgacctcaggtgatccaccctcctcagcctcccaaagtgctggggttacaggcatgagccaccacgcccagactattagtttttaccatgttttattgaaatatatgtcatgggccggccacggtggctcacgcctgtaatgccagcactttgggaggccacggcaggtggatcacaaggtcaggagtttgaggccagcctggccaacatggcgaaaccccatctctagtaaaaatacaaaaattagccgggcgtggtggcaggtgcctggagtcccagctactcaggaggctgaggcaggagaatggcttgaacccaggaggtggagatttcagtgagccaagatcacgccactgcactccagcctggccgacagagtgagactccgtctcaaaaaaaaaaagaaatacatgtcatgaagaacacagatggtgcaggtctagcttgttgatgacttttcacaaactcagcacagccacagaaactgctcctagatcaagaaacagaatatgctctgcacccaggaagccccctcacctggggctctcacagtcactggccctcaaagggtcatttctgacccactccccaccctccgctccattgttggttttctcgccgtcttttgttggtgcgcaaatcttaactgtacaattggctgtacaccctcatcacaataaaggccatcgtcatctccccagaaagttcctgggtacccattcccagccaatctgccctgctccaggcaaccgctgatctgatttctgtcacaatgggttgcatctctgatgctgagatttcccagtgttgctgagtagtatccgttgtatgaatgcacagtttgccgggtcacatgttaattcaagtgtttgacttgtttccagtttggggccgctatgaaccaaggctgctgtgaccattcgtgtgcaggtctttgtgtggacttgcactttcatttctcttggggtggaacggccaggtcacaggataggtgtgtgtttcacttgatcagagggagcacccgcaccacctcacagctcaacttcagccattttcattttcttgccttactgcacttttcttgttcctgattgcttaaagggatgattaatatttcagcatttcctataagtgtgatatttgtagtatttgtaaggatgatggtttgggggtttttttgttctttgttttttggtggtggtttttttttttgagacgacgtctagctctgttgctcaggctacagtggtgtgatctcggctcactccagtctctccctcctggttcaagcgattctcctgcctcagtctcctgaatagctgggattacaggcatacaccaccatgttcagctaagttttgtatttttagtagaaatggggtttcaccatgttggtcaggctggtctcaaactcctgacctcaagcgattccccgcctcggcctcccaaagtgctgggattacaggcttgagccaccacgcccagccagaatggtgttttatagatgccctttatcaagttagtgaagttcccttgcattccccctctgctaagagttttagcgtgaataggtgatttctgaaacacttgatctacatctgttgggttgagcaagattgctagatttaaaaaatcaaaacatagcagtaggcagagagttcttagaggttttttttaatctcttaatatggtgaatttcaatgatttttttctgttaatatcaaaccaactttttatttacagatgtatttattctgtaaataaaaaacctaccgtttttaacattgcaggatttggtttgctgatgttttcttctttttttttaaagagacagggtcagtgggtcgtcgtggctcacgcctgtaatcccaacactttgggaggctgaggcgggcagatcacttgagcccaggagttcaagagcagcctggacaacatggggaaaccctgtctctacaaaaaatacaaaaaattagctgggtgtgttggcatgtacctgtagtcccagctactccagaggctgaggtgggaggattgcttgagcccagaggcagaggttgcagtgaactgagatcgtgccactgcactccagcctaggtgacagagtgagaccatgtctttaaaaaaaaaaaaaaaaaaaaacctcctgatttcaagcaatcttcctcccaccttggtctcccaaagtgctggggtgtgtgagttgtgcccggcctgctgatatttcgtgtgggatttctgcatctgcatgtgtgtgtgaatgaggcgtatgggttttcccatgtgcctttctcatcaggtttccgtaccaaggctctgtaggccccataaggtggcttgggaagtgttcccctttcttccttctgcaggaagagtttgcttcaggctggaattctcttgtgcttgcattttggtagaacccactggcaacactctctatgccagggggttgtttctgtaggaagatttgtggccactgtcccctctcaggtccattgctctgttttttgtttgtttgagacggagtttcgcttttgtagcccaggctggagtgcagtggcttgatcttggctcactgcaacctccgcctcccaggttcaagcgattctcctgcctcagcctcctgagtagctgggattacaggcatgggccaccatgcccagccaattttgtatttttagtagaaacggtttctccatgttggtcaggctggtcttgaactcccgaactcaggtaatccatccgcctcggccttccaaagtgctgggattataggcttgagccaccgcgtccagctgtttagttgtttttttgttttttgttttttgagacggagtttcactcttgtcgcccaggctggggtgcaatggtgcaatcttggctcactgcaacctccatctcccgggttcaagtgattctcctacctcagccttccgagtagctgggactacagacacccgccaccacgcctggctaattttttgtatttttggtagaggcggggtttcaccgtgtcagccaggatggtctcgatctcctgacctcttgatccgcctgcctcggcctctcaaagtgctgggattacaggagtaagccactgtgcccggcctatgcccttttaaaaaagcaaccatgccagggggttgtctgtttctattcgtctttttcaaacaccaatttccagctttgttcatcttttctttgggttagcttttaattttattaattttacttgtcattatttcctattttcttcctggtaatttggcttgcagttctatctttttctcactttttttttggagatgaagtctcactcttgtcacccaggctggagtgcagtggcacgatctcggctcactgcaacctctgcctcccggattcaagtgattctcctgcctcagcctcctgagtaactgggattacaggtgcctgccaccacacctggctaatttttgtatttttaatagagatggggttttgccacattggctggtcttgaactcctgacttcaggtgatctgcctgcctcagcctcccaaagtgctgggattacaggtgtgagccaccgcatctggccctttttctcacttcttaagtggaatgcttagctccttatttttgaaccactcttttttgctaatgtaagcacttgaggtcacgtctcacaaatgtggctacatggtacttctgtcgtcccttggttctactgaattgaattttcaggttttctcctggaacgcaggagatgcgtttatgtcttctgggtcagggatggagggctggcacaggcttgaatctcggggctcttctgtctgtatatcaggcaagacagacatgcttgtggcccagtagtgatcctgagtagtgcccagatcaccaagggtggaggatgatgtatgtaggtcgtgtccccagccacttctaaccacacacctgttccctctgccacagggtgacctggccaagaagaagatctaccccaccatctggtaagtgtgtcccaccactgcccctgtgacctcccgccagggacaggcctggtcctgccctgcccgcactggttacagctgtgccctgccctcaggtggctgttccgggatggccttctgcccgaaaacaccttcatcgtgggctatgcccgttcccgcctcacagtggctgacatccgcaaacagagtgagcccttcttcaaggtgggtggtgtcagggcctcccccagcctggttctgccctctctaccagcccccagcatggccagcttcggggacctccccccatcccatcccgggatgctctcctcctctcctgccccgccccgcctgctctcgtacttccttgagacccccattaccagcccccgtgaccaggacccacaggtcccctcctgctgtgctctgctgcgttttctccgccaatcatagttgggtgtcatgattttggagagagagctttctccagtgtatttctcccaggtcaaaatatcctgaaatctggcctctgtcctaaggcacaggggtcccagcctggggcagtgtctgtgctgcctgctttggcctccctccctctggatgtgcagagctgctaagatggggctgaacccagtgtgggacggggacactgacttctgagggcaccctccctggacctccagggaagaccctccactcccctggggcagaacacacacggactcaaagagaggggctgacatctgtctgtgtgtctgtctgtccgtgtctcccaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagatgtaaggcttgccgttgccctcccttcccgcctgccaggctggcccaggcagtgctcccaccactctatgagcgtgtccggggccggggatctgggcagcatccatggtgccggggccatccccagcgggaccacaaggtggcagcgttgctccacgaaacaccgcctttccgctctgcttccccaaaggcccggccaggccgcagggtggcagccttgctctgcgaatgcagcatggcccgcgctgggtggtttcccaacccagccagaggctcttgtcctctggctggttttgaatgcgggggtagtaaagcaaaggtcctcttctcattttcaaaaccaatgaggaagccatggcttggatgcctcctccccctgctcccctacaggccttcaggccactcagacccaccggggacccagcatgaggcaggaggggaacgggcccccggcagcatgccagcaatgccaccctggcacccagggtgggaaggcttcccggaaggtgttgagccagagggtcatctgggaacacaaggcacgggaggtggccacgggggcgaggaggttctggcctctactcccctgggagggcgtctgaatgatgcagctctgatcctcactccccgaagaggggttcaagggggtaacgcagctccgggctcccagcagaggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgaggtggggccaagcctgggccgggggaccagggtgggggtggtactcaggagcctcacctggcccactgcctccccgaggacgaattcctccagaactcagacaagggtgacccctcacatgtggcccctgcaccacagaggcccaaggtcagttcctccaccttgcccctccctgcagatttgccaacaggatcttcggccccatctggaaccgggacaacatcgcctgcgttatcctcaccttcaaggagccctttggcactgagggtcgcgggggctatttcgatgaatttgggatcatccggtgagagctcttcctctctcctgggaggctggcacagggtggcagagccagtcaccctgcagggctactcttccctatcttgggggagctcctcctcaccctgcagttcaaaacctaagtgtctgagctatcagaccgggctggaaagggctggacccctacacagccaagcaccccacggttttatgattcagtgatagcatcaccatgtccttccttgatttaaggggacctggaagacaagggggatcaggaagtgagtcttgcagcttgtcactaggaagccttgtttggggtccccatgcccttgaaccaggtgaacagggcggggagctaaggcgagctctggcctcttccgtccccagggacgtgatgcagaaccacctactgcagatgctgtgtctggtggccatggagaagcccgcctccaccaactcagatgacgtccgtgatgagaaggtagggggtgcaccccagtccccaggagcatgccctgtcgcaggcccatctgtgacgaggcactgagctggggtgtgcatgcagagcaggtgtcctcaaccccggagaagtcaccacctctgagcacagcgtggcctcccggaggtgacctggactggcagtcatgaagcccaagttgtcatgtcccaggcctgacagtcactatgtgaccagggaaggccattgcctctctgggcctcagcttgttcatcagaatagactcgagatggaccagggtggtcctggagggtcctcagggaggggccctgagctgggcctctggcagggtgagcagagccaagcaggggcctcctcctgccctgagggctgcacatctgtggccacagtcatccctgcaccccaactcaacacccaaggagcccattctctcccttggctttctctcaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggtaggtgatgccttcgaggcccagcaaggcagaactgggcatgccctgtgtgcgggcactggagctcccactgagacactcacgcactggtccacaccctgagagagctggtgctgaggctgccctttccgccacgtaggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaaggtgccctacagagaaggagcagtgtggagggtgggcggcctgggcccgggggactccacatggtggcaggcagtggcatcagcaagacactctctccctcacagaacgtgaagctccctgacgcctatgagcgcctcatcctggacgtcttctgcgggagccagatgcacttcgtgcgcaggtgaggcccagctgccggcccctgcatacctgtgggctatggggtggcctttgccctccctccctgtgtgccaccggcctcccaagccataccatgtcccctcagcgacgagctccgtgaggcctggcgtattttcaccccactgctgcaccagattgagctggagaagcccaagcccatcccctatatttatggcaggtgaggaaagggtgggggctggggacagagcccagcgggcaggggcggggtgagggtggagctacctcatgcctctcctccacccgtcactctccagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacgagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagcccctcctgtccccttgtcatttgcttccctgaggacccacttccttgtcccactccccaagtcacccgggtgcttcctctgtggccactgaggagcctcctcacttctggttctgaccccatgtccagccatgaccatgtttggtgtcagagacacctcctgagtcctcctccgctccacgcatattgtcattgtgagaccagcttgaggtgcaaggatgtggggtcaccttccgctcttactgtccatgtccctgccccacccaagatgacttccagcaacactgccagtccacagaagtatttaggaaggagaggggatgggttttgtgactgatgtcagaggccaagggagaggggacagtccacagtgatgcacagccaggcccagccaccccttccaggcagaagggccacacactgggcagctctcaacataggctgattctcccagttctggaggccagagtccaagatccagcactcccgccagaggcccaaggggagggtccttcctgccctctccagctcctggggaaccaggcatcttgggctggtggtcacctcactccactcactctgcctgtcttctcgtggcctccccatggtgtgacttctatgtcctaactcagcgacatctgcagacctcctatttccaaataaggccacatcaggaactcccaggagacatgtatttgggggccgctgttcagcccctgcactgctccccacacagcccctgggtgtttcagtgcagcatgtgtcctgccagggagatggcgaaaccagacactatggtccctgcacttgtggcccgggttctaggaggtgaggccggcagggaacaaaataaccaggtggtgctgggatttgtcctttgcggagagcaaaccagtggcctggaaagtggccagggaggagtgttccacccgcagcacaggtgaggacgcgcaccctgggcgctgcaggtagcagggcccgatgtcgtagaatgaaggaggcctctggtgagacctgtggcaacagggacacatgctgcatcccggtgttcaattcttgctcttcctgtgccctgaatggggagtggcacctcttgagttttcagagggaggaagtatgccaagttcacctggaccctagatagggaaaggagcttgatgggggccaaggacaggtcacaggctcagtgggctctgtgtgcacaggattgggggccaggcttcggccacaggggcagtggttttagtcctcttgtcctggttcctgtggcctccagaaggggctgtggcaaggctgagagtcgggttgggctgggggctgatggggtgtggtaaggctaagcagggtaggttccagggcagggaacaacacccaagtaaggccaggcgcagtggctcaagcgtgtaatctcagcactttaggaagccaagatgggcagatcacttgaggccagaagttcaagaccagcctgaccaacatgacgaaaacatgtccctaccaaaaaaaatacaaaaatttgccaggcgtggtggcgggcacctgtggtcccagctactcaggaggctgaggcaggacaatcgcttgaacccgggaggtggaagaccatccactggcacctgaacccatcaggcaactgtcccttcagctctgggcgcctacttgggtggaggcaggaggtcccaggtgaggacagcactgggtccacaatgggagagaatgagagatcaggtcagggcattccactgtcacctcagttgcgggtgtccacactgagacatggacataagcccgagaaaacaacacgagctgtaccctgaacaagaaggcagtcctccccagccccttggagctcacaggagcactgaggcccttgcctgtgagcccagatccaccctggcccattccatagggtgactcactcagcctccctgacccctgctgaccggttcaaggctggagccctgttttcaccccttctctgcctgcaatgccaaagaattca

SEQ ID NO: 18 - DNA, 10461 bp, Homo sapiens
gctgaatgaagttttctgggtaatggcatgaaatgttttccttatgagaagtggtgttgagttacagcgtgcagacggagaacggggaggagagaaacggcagtctcaatctggcccccaccttttcttgggcttgtaggaaggtggacatgggctcccggagacaagacaagtgatatgttgaactgttcggtggctggaatcaactgctcctggagtgacctaaggccagtgtttatcagaacttagccagggccagccaagcaggcacagatgctctgctatgaaatgccacgcaggcagagactgacaagcggtaggaactgagctttccccttggactgctgcttcctgctgtgttcaggggagggggtcactttctggcaactctgctgctgctgctgctgctgctgctacttcagcttcctctccactcaaggtaagcaggctaagggagggcaggctgctagggaaagctttgtaccatgaacaggatccgaaagtttttccgaggaagtgggcgagtcttggcatttatctttgtagcttctgtcatctggctcctctttgacatggcagctctccgcctctcattcagtgagatcaacactcgggtcatcaaggaagacattgtgaggagggagcggataggattcagagttcagccagaccaaggaaaaattttttacagcagcataaaagagatgaaacctcccctaaggggacatgggaaaggggcatggggcaaagagaatgttagaaaaactgaggagagtgtgctcaaggttgaggtggacttggaccaaacccagagggaaagaaaaatgcagaatgccctgggaaggggcaaggttgtgccgttgtggcatcctgcacatctgcagaccctccctgtgactcctaacaagcagaagacagacgggagaggcaccaaacctgaagcctcctctcaccaggggacaccaaagcaaacgacagctcagggggctccaaagacctcattcatagcagcaaaaggaactcaggtagtcaaaatatcagtacacatgggacgtgtcagtttaaaacaggagccccggaagagtcatagtcccagcagtgacacatcaaaactagcagctgaaagggacttgaatgtgaccatcagtcttagtactgatagaccaaagcagcgatcacaggcagtagcaaacgagagggcacaccctgccagcacagcagtgccgaagtctggggaagccatggccttaaacaaaactaagactcagagcaaagaagtcaatgcaaataaacacaaagccaatacgagtcttccttttcctaagttcactgtcaattcaaatcgcttaaggaagcaatctattaatgagacacctttgggaagtttgtcaaaggatgatggagctagaggggctcatgggaagaaactcaatttctctgaaagccatcttgtgattataaccaaagaggaagagcaaaaggcagaccccaaagaggtctctaattctaaaaccaaaacaatatttcctaaagtattgggtaaaagccaaagtaaacacatttccaggaatagaagtgagatgtcttcctcttcacttgctccacatagagtgccactgtcccaaactaaccatgctttaactggagggctagagccagcaaaaatcaacataactgccaaagccccctctacagaatacaaccagagtcatataaaagcccttttacctgaagacagtggaacgcaccaggtgttaagaattgatgtgacactttctccaagggaccccaaagctccagggcagtttgggcgtcctgtagttgtcccccatggaaaggagaaggaggcagaaagaagatggaaagaaggaaacttcaatgtctaccttagcgatttgatcccagtggatagagccattgaagacaccagacctgctggatgtgcagagcagctagttcacaataacctcccaaccaccagtgtcatcatgtgctttgtggatgaagtgtggtccactctcctgagatctgttcacagtgtcatcaatcgctctcctccacacctcatcaaggagattctgctggtagatgacttcagcaccaaagactatctaaaagataatttggataaatacatgtcccagtttccaaaagttcggattcttcgcctcaaagagagacatggcttaataagggccaggctggcaggagcacagaatgcaacaggtgatgtgttgacatttttagattctcatgtggaatgtaacgttggttggttggaacctcttctggaaagagtttatttaagtagaaagaaagtggcctgtccagtaatcgaagtcatcaatgataaggatatgagttacatgacagtggataactttcaaagaggcatctttgtgtggcccatgaactttggttggagaacaattcctccagatgtcattgcaaaaaacagaattaaagaaactgatacaataaggtgccctgtcatggctggtggattgttttctattgacaaaagttacttttttgaacttggaacatacgaccctggccttgatgtttggggtggggaaaatatggagctctcattcaaggtgtggatgtgtggtggtgaaattgagatcattccctgctcccgagtgggccatatattcagaaatgacaatccatattccttccccaaagaccggatgaagacagtggagcggaacttggtgcgggttgccgaggtctggctggatgagtataaggagctgttctatggccacggagaccacctcatcgaccaagggctagatgttggcaacctcacccagcaaagggagctgcgaaagaaactgaagtgcaaaagtttcaaatggtacttggagaatgtctttcctgacttaagggctcccattgtgagagctagtggtgtgcttattaatgtggctttgggtaaatgcatttccattgaaaacactacagtcattctggaagactgcgatgggagcaaagagcttcaacaatttaattacacctggttaagacttattaaatgtggagaatggtgtatagcccccatccctgataaaggagccgtaaggctgcacccttgtgataacagaaacaaagggctaaaatggctgcataaatcaacatcagtctttcatccagaactggtgaatcacattgtttttgaaaacaatcagcaattattatgcttggaaggaaatttttctcaaaagatcctgaaagtagctgcctgtgacccagtgaagccatatcaaaagtggaaatttgaaaaatattatgaagcctgaagtgtaactgatgtttttatatagtaaacccattaaatactgtgaaaataacactgaacttggaaactatatttctcagcggtagtttaaattttcaattttaataacatttgaatggaagattttttataaatcacaatatttggaataccaaaagatgactcaggaaaacagtccaacattggactgaagtccttcttcggaactgggtggcctttgaattgcctgctttccaccctatgctagacctcatcatgcaaatttccctgtgaaagctaacaggtaactggaaatgaagacagaaggacttgagaaagcatgaggatattcccaatgactatgtttggtaataatcagctcttctggcccacaagtaggaatgatcaatgagaacttaacttagtcctttatttggggattttttcatcaaacaaaaatttcttgagttcttatggctagaagacctcagatgcccacagctgtcacgtttgtgaaatccctccagactacatgcatgcttacctaacagtttgaaatagtattgatctactgctggtaaccctgcttgatggcagcattttgatctaaattacataatggtttttcccaatctgaatcagtggaaaaaaatttaagtgaggaagaagaggccttcaaatgcttatttaattctaggtatgaacactatttcagttcattttgtgcttttaaaactacagttttaaagatttatgataccaataacttcctagattcatgtggattttttttaaggcaatgaaaaaaggctggattataacacactgtagtaatcaaaaatgcatttaagcattgaatgcactctagtgcagggccaagtaagaggagttgaaatgagtaaagcagaaatagagctgctgaaagtttcttttatataaaaataataaaatactactttagatatagtagcattcacagggatgaaatatgcgaaaaatgggttctaaaatatttcaaagggaaaatgaagtgaaggaaacatcatgaaaggggaaaggaatgaggtaaacaagtcttaggaagagagttaagaaaaaattccgctggacttggccaaagaaagaaggggatctagtatctctatgaaggaaaaaagagtaaagccctcagtgtgaacccagtgagaacactgacaaatttgggaaaagttaaatactgatttcatccaaataaagcctctaatcttaagcataccaatactttggcataccagaagacaccttagaaatcaggatagcctttgcattcattttggtaagaaaactgatgctgagaggataaattacctaaaaatcttaaaacccaggcaagttagtcaaagaatcaagattagaattcaggtttccagagacagggctcattctaatgcctcaggtcactggcccgaacaaatctgcttcacagaattccttagaaagagatacacaattctttgctgggattgggtccctggaggacaaccatactatattcttgttaatatgttttttctttttttaaatttaaacttttgttcagttgagatgattgtgaaactaggtatctttcattctgactcctagtttaacatttaattttgactcccaatgagttacgtaaaagcaaaactataactaagaatgggaaaaagaactatttctgcacatttgtaacatatttaagatgttttcttcatataattgaaaactgcagatgagtaagagaatgactaggaaatgagatacagttatatgacacataatgatgttttagtcaacaatgaaccacatatttgacattggtcccaaaagattatattaataatatggtatctttagtgtgcttttctatgtttagacacacaaatactcaccatgatgttacaatagcctacagtgttcaatacagtaacatgcacaagtttgtaacctaggagcaacagggattccatatagcctaggtgtgtagtaggctacctacaccatctaggtttgtgtaagtacactctgatattcacacaatgatgaaattgcctaatgacacatttctcagaatgtatttgtgttattaaatgatgcatgactctaattcttttcaaaacagagccatatggggcaagggggatggggggacgcaagtcagttgtcaaaagactaattgagttactgacaaactgaacatgctaggtgcctcatgtaattcttcatgtaactaaaaaatgttgagaggtttttttcccccgggtatataggctctctttttatccgaaaatagtttccacaaagaagtcaactctgttctgaaaaaaaatgaattgcattttgaatacacttatctttgggtatatcaactaaaggaagttggatttttttccttaacagaaacttctgcagtcctctcagttcacatcctttctgactttaccctgacaaacttattatataaagctatatttaaatctatattgtcaatataacaaaggattgtttttgaacatcacaaatttgttcttggatagaattttatacattgcttttcatcatatatttgctcagttactctaagaagcaaggaactgatcactagttgggaatctatatgggcctaaacttgagtgtattgatttattattacatctactaccaacattttcttaagcatagccttctaaattttttcaggagattagaataaaggtatacatgctactcggtcttctggtaattctagtgataaacctttggatgagacaggtcctaatcagcactgaattcttcaataggaggctgtgttacaggagctacagatttttccctggattagcttaggtcattgcctttactttaaaaaaaaaaaaaaaaagtctatgcatcttgttaccttgaatacaagggtggtcttgataatatttgacagcactaaccaacttaccaagccatctaagtgcttctgagacttttcagtttgcacaatttctttctccttttcaacagttacccagcgcttctgccctactctcttgtaagctgacacagttgttgttggtacaatcttgttctatcaccagcatcaaatttgcttaatactgcttgttgacatcccctcagctgtcattcacagcaaaccaccatgtgccatgatcacaatgtattattagcttcgccacactaatttggaaacattcttttagatattaaaacaccttacttctagtattagtttgggactgcagaggggcaaagataccatttacagtatataggagtccaatattcccaaccaaccttgatttcatgaatggcttgtaattatttctagcaggcactcatgcaatagaataagattgaaacatgccagagagtaccatctttctttgttttaacatctctgattgaattcctatattcagaatacaagaaaaaaaatttaccaaccaggcgcagtggctcacacctgtaatcctagcactttaggaggccaaggtgggtggatcatgaggtcaggagttcaagaccagcctgggcaacatggtgaaaccccgtctctactaaaaatacaaaaattagctgggcatggtggtgggcgcctgtaatcccagctacctgggaggctgaagcaggagaattgcttgtacccgggaggtggaggttgcagtgagctgaaattgcgccactgcactccagcctagacaacagagcaagactctatctcaaaaaataataataataatttttacctcagaagaaagccccaaaatcttggattaaaacaaaaaaatgacattgggtgatgggaaaaaagaaaggaactaattatcattgagtgtgtgtaggtactatttgtgtaggtgctatatgtgtcccatctcactgatgggtacaactcatcaaatgactctcattctccctgttatatgaacaagaaggataactcccacatacagatgaggaatttggtaaattgcccaaggtcatcccacaagtaagagataaaacccagtttccattttatctggctcaaaaaaaatttctctcactataccatgctgctatataattaattttcttctttacaaagggctgtcatctcaggtgggtgcatttaaaagtttcttggtctcagattactgatgccacagtattgagatgagattgaattaaacccctttggcctcttttggatgttgtataaacagaaaaaagaagcatggtctctctctctctgtggtaaccaattgatgtgtaggtataaacatggctacccccacatgttttgctgtgatctatctctttgacttcatgcagaacctattctttttcatctcctggaccaaatgtgaaagaaagaagtggacatgtggaggattctttctctgtgaataatattgaaaaagctccattttctggggaaatacccatggttcattgtctgatgccaagaaagaattcaggacacagacacacatgaggagtgggtttaggagtggaaagtttaatagataaagaagagagtgagaaagcttcctcatgttgagaaagacagttgctcaagagagggttttctgggtttggggcaagatttgattgatttcatacagaggcttgaggaggcggtgattgatatacatagggcccggggattggtttaaccaggtatactacttacatagccggtgaaaagactggccctcccaccctaaccttttattatgcaaatgcatcttctacctggctgtcaccatgacatttgcacacgtggcttcacttcaccagtgccatgtcacccacacacctggtgacaaggaaaagggagcaggaatcaccatattgaatgtgcctggcttccaggtacagctgctagctttacatatgggagcctctagcttgcatatctatacttgcaacttgacttttcaggctgctttttgttagaaaataagtggcttgggggctgctttttattaaaggaaaaatccaccgagaactattttaccctttctaatggcctaaaataaatttttaatgactcctgtattaatattaccaacccttgatccctccaacctttaatcaaagctagcagattgctcatcttgaacagaaataaaaagttaaaaagttggagtcctttaaaacacaaaccatgactttttattcctactcattgtgtaggttgtcactactgtgcttttgcaacaacttttgcatgggttactcaatagttgctacaagacaaaatgccttacaattagaaaaaaaaattaaccagagatattgtacaaaatatttattttttgacagttttgaataagccatataaagtattatatatccctaatgaagcttaatggatagtattccaggtgttggtggtgtctgtatctcaaagaaagaaaaaaataacatcacactaaacagatttaatgcctctgttttcaacctaatggaacaatagttatcatttcaattagagtcgctttgcaagtttatgtgaatctttgctttgtaaaaacacatacaaaacacaagggaaaattctcattttccagcaaatacagcaacttctaatatgctgtttctaataatgagtcaccatcaaataagtaataaatatttttttcaaaaacaagagctttctgttttattattgattgacagatatttaccagtttaaggatattggtcataagcatctatataataaaccctttatattagatgttaaattaaaatttttcatagcatgaatagatttttaagtgaccactcaaaaacatagcaatttttgtaaatatactgtatgtgtgtgtatatatatatatatatatatatatttttttttttgatgctttgatctggaagaaagaaatatcaagagtttctattcacaacataaagaaaataaaatgtttttagatatttttaactctttcaggtgtatagctttgtctgcatctggccttctgcacaaaagtatctcaagtgaacttacactctggataccattttccaaacttgaaggagtaatcaagttcttaattatcagggtgcttgttatttagttgaagattacacacatgtcttctgcttcaaacaactaccccaaatttgctagttttatacatattagcttaaaaacaagagaagccaaagattaagtaagtgaattgtgttaaagattgcctgaaaacatttgctaaggggagaataaaactaaaactgtggagtataaaggatgttggaattaaacatttttaagtactttttcttttgcatctgatcgactgaagttattataaagaaggaatcaagtatgtaactttaaattctaggtaaacatccaaattactttctaaattcatttccaaaattctcctgtgctggcagttagctactagagatcatcatttgattttgtagtttgccatgttctgagtgagttcagctgcttactactacccatgtcattgtgtttgtattgattgcctggctcagttatctcatgttcttcatgaactatatacacattttcattgtctttaaacaatactgagttttgaagttaagtagaatattgtaggggttatcagaaacccatattcattgtggtatgtttctgtctgatactttaatattggtaaatatagtttttgacattgcattttacaatcctattgttttttagagtgatgaaagttcaagttttaagagaagtggttgcctttctcatactgtcaaacatatttcttctttattatactctggtgctttatccttctccataattctctattattacttattttaaatgttttccctatcacattgaaaaacttaaatgtccgttctccatttgaaaatatgccaaaagtatgatcccatgtaaatatgcagaaacgattgctatgaaaatgtcagcatagtttaaatgtattactctgatgattacagagatttcttcaagttgttcgtgttaagatgcatcttaaacatgatctcagttccttaaaaaatgataaaaatttttcatgtatattacatatctacctaccagaaatcctttttacaattttatatacaatcattttaagacctttttgaaataaataatgcaaatgaactaaaaaaaaaaaaaa

SEQ ID NO: 19 - DNA, 1446 bp, Homo sapiens
tgtacacaggcagtttgttgggagcgttaccattgcctctggttcctcatgtgtaaaatggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggctatgtggttgatgttgcagaatgatgagccggaggacttcgttatagctactggggaggtccatagtgtccgggaatttgtcgagaaatcattcttgcacattggaaaaaccattgtgtgggaaggaaagaatgaaaatgaagtgggcagatgtaaagagaccggcaaagttcacgtgactgtggatctcaagtactaccggccaactgaagtggactttctgcagggcgactgcaccaaagcgaaacagaagctgaactggaagccccgggtcgctttcgatgagctggtgagggagatggtgcacgccgacgtggagctcatgaggacaaaccccaatgcctgagcagcgcctcggagcccggcccgccctccggctacaatccccgcagagtctccggtgcagacgcgctgcggggatggggagcggcgtgccaatctgcgggtcccctgcggcccctgctgccgctgcgctgtcccggccgcaagagcggggccgccccgccgaggtttgtagcagccgggatgtgaccctccagggtttgggtcgctttgcgtttgtcgaagcctcctctgaatggctttgtgaaatcaagatgttttaatcacattcactttacttgaaattatgttgttacacaacaaattgtggggccttcaaattgtttttctcttttcatattaaaaatggtctttctgtgaactagcattcaca

SEQ ID NO: 20 - DNA, 3958 bp, Homo sapiens
gttcacttactggtgcccagcaccgggcactcagtgaggccttgcaatacggttcacttgttgaattgaattcgtcaattgttgagcgggccgtgctgccaggcaccgcacgttgtgtgtctgccctactctcgtggaaccaaggtccagtggagagaggaacataagcgaatgaagaaagaagcaatagagtctcagtgataagttcttggaaaaaaggtctttgccaatcctgattcccggaagagagtcggcagaattccttcctttaggcccctctggagccttggccgaccagccacttctgtggtctggggacagtcaccgagggtatcaaaaagccattcacagaggtcatccgagccaacatcggggacgcccaggctatggggcagcagccaatcaccttcctccggcaggtgatggcactatgcacctacccaaacctgctggacagccccagcttcccagaagatgctaagaaacgtgcccggcggatcctgcaggcttgtggcgggaacagcctggggtcctacagtgctagccagggtgtcaactgcatccgtgaagatgtggctgcctacatcaccaggagggatggcggtgtgcctgcggaccccgacaacatctacctgaccacgggagctagtgacggcatttctacgatcctgaagatcctcgtctccgggggcggcaagtcacggacaggtgtgatgatccccatcccacaatatcccctctattcagctgtcatctctgagctcgacgccatccaggtgaattactacctggacgaggagaactgctgggcgctgaatgtgaatgagctccggcgggcggtgcaggaggccaaagaccactgtgatcctaaggtgctctgcataatcaaccctgggaaccccacaggccaggtacaaagcagaaagtgcatagaagatgtgatccactttgcctgggaagagaagctctttctcctggctgatgaggtgtaccaggacaacgtgtactctccagattgcagattccactccttcaagaaggtgctgtacgagatggggcccgagtactccagcaacgtggagctcgcctccttccactccacctccaagggctacatgggcgagtgtggttacagaggaggctacatggaggtgatcaacctgcaccctgagatcaagggccagctggtgaagctgctgtcggtgcgcctgtgccccccagtgtctgggcaggccgccatggacattgtcgtgaaccccccggtggcaggagaggagtcctttgagcaattcagccgagagaaggagtcggtcctgggtaatctggccaaaaaagcaaagctgacggaagacctgtttaaccaagtcccaggaattcactgcaaccccttgcagggggccatgtacgccttccctcggatcttcattcctgccaaagctgtggaggctgctcaggcccatcaaatggctccagacatgttctactgcatgaagctcctggaggagactggcatctgtgtcgtgcccggcagtggctttgggcagagggaaggcacttaccacttcaggatgactatcctccctccagtggagaagctgaaaacggtgctgcagaaggtgaaagacttccacatcaacttcctggagaagtacgcgtgaggacgcctgagccccagcgggagacctgtccttggctcttcctcccaatgcccgtcaggctgaactcgcctcccccgtgactctgcctcgggcctcgcagaggccgctggtcacttcgtcatcattttgcccctggagacgtctttctttgtgccttgatgttgagagcgcctctcttttgagcaaacaagcattctatatgcaaccagagtagaggggacctgctcagcaggtgtgaccagggttctctgaatctgttattgtttttgcttctggaaagttcatttggggtttacaacaactaggatgtgttgggtgagatgtttcagatctggagaaatgagcaggtgtcgggaaatgtgtgacttaaccgtggtgagggctggaaatccaaactcaccaccatgatctgtgaaataaagcccttagcggtgtgaagcatccggtcctttgaacagaagggcctggaaggcccctggggctgagaaagggtccgcccggtggcctggaggcaggcgccgggagcgcagtagcacgtggactgggcaggatgttgcactagcttggggtagatgctgggggctgcggccacggtcagagggccccactgtgaggcgtgggtgtgagccaggctgcaggaggaactgggcctccgcttcccagcaacgcagccaggcctgagaattctgtgcgcccggcgggctttgggaatgaggggttcccttgaacatgcgtaggctggaaccccgtctgagaggtctccctgaatttcagtgacacatagtgcagcccggcagtgtcccacttccgtggagagagccgctggaatggtgtggacccatcccgcgggtgaccggtgcctgttctcccctgaccgagcctgtgagcacatcgccccctgctggcgacagcggggaaatgagggctgaaaatatcctccccacaagggcaatccccgggacctgccgagcagccaaggccctgtcctttcttgaatggtggcgagctgaatctggtcggtttcctagcttttaggtggtaaaagtgcctggcagcttggctgccgtggaggagtcagtcgtggttggaggttcattgccgtgctttcatgcagagtgttttgccttcatgttagcttccggctcccctcccaggctgcagactctgacctgtggcatcaggcttctcccagtacaggagggtgccatcccccagcatgcggcttctctgccattagcagccctgggcgggccgaccacactcgaggctgcggtgctacgggcttagccctcgcctccctcactgggagcttccccatcctccctgccttccccagtgggaagttagggaagctcaggagcctgggaccccgcatgtcccaaaatgggattggagaagctggagagaaagcagaagaggccgaggagtgaggcagcagcctctatgctgtgatttccacaccgggtccgtgcagaggaaacagaaactcccaactgtccttacccaccgacatcacagcccctatgaagaaagtagccacaatctcaaataacaaaagggaatgttctaaaactttttcttccttaaaaaatggagaaaattgcacttgtgcttgctgtgtggtatataaaccaggattagtcccagggtcgtgaggtttctggtgaaaaggttaaatcgtagaagctagtatattttttatatttttgtaacaattgcttttttcatgggggaggcggggttagtatttatagtcctaacaagtccagtaattttttataaatcttcagattataaacagcccctaaaaactttacaacgtttacacagttttttaaaaagagactgtatacacttgatttgctttcaaaataaataaggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggctgtgcctcagacagtgcatcaccgggcacccagaggcttgcctggctattcctgttctggtgtgtgtggagtgttggggaggaacagatgcagatcaacctgtggctgttttcccgtctaggttctcacaggtatctcctgacagaggtacttaacaatggctctgctggaaatttctataaataaaatgtccaaaatggtgactgcgttt

SEQ ID NO: 21 - DNA, 1186 bp, Homo sapiens
ggctggggcggagctggaccgttgagggccacggcggggcgtctccgggccgagcggggctgctgcgcccgagcggttgggggcgcggagggctggaaatcccggatcacgcgcccccgggcgccgccccgcccccgcaccttggcctagcgcggtggcgtcacagtcgcgcagtcctgactacggcctccgggccctttgtccccgctagcggcgctcggggtgggggagccaggaggggcgggagacgggcgggtatgggccgcgcgggcgcaggctcccccgggcgccgcaggcagcggtgccagagccggggcaggcggcggccgcgagcccctcggcggcggaaggccccagcgtgcaggcgcaggagggcgcggcgccggcggaagaagccctgtccccgcagcttgcgaccggagatccacgaatgtcccaagtcccaggacccgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctggataaaaaaa

SEQ ID NO: 22 - DNA, 1155 bp, Homo sapiens
tgtcccctctccggagctcttatactctgagccctgctcggtttaggcctgtctgcggaatccgcaccaaccagcaccatgcccatgatactggggtactgggacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccacaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23 - DNA, 4144 bp, Homo sapiens
ggttggttctgagaaggcttcaaggaataggcagacatttcagcaaggctgctgaggaaggataggctgtggaaattaggatgcagcactcctgcccgggtcccgcctcggggtcgccaggccctgaaccccaacgccggcattagtcgcgcctgcgcacggccctgtggagccgcggaggcaagggacggagaacggggcggaggcggagtcagggcgcccgcgcgtgggccccgcccccttatgtcgggtataaagcccctcccgctcacagtttccctagtcctcgaaggctcggaagcccgtcaccatgtcgtgcgagtcgtctatggttctcgggtactgggatattcgtgggctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttctggggaaattctcatggtttgccggggaaaagctcacctttgtggattttctcacctatgatatcttggatcagaaccgtatatttgaccccaagtgcctggatgagttcccaaacctgaaggctttcatgtgccgttttgaggctttggagaaaatcgctgcctacttacagtctgatcagttctgcaagatgcccatcaacaacaagatggcccagtggggcaacaagcctgtatgctgagcaggaggcagacttgcagagcttgttttgtttcatcctgtccgtaaggggtcagcgctcttgctttgctcttttcaatgaatagcacttatgttactggtgtccagctgagtttctcttgggtataaaggctaaaagggaaaaaggatatgtggagaatcatcaagatatgaattgaatcgctgcgatactggcatttccctactccccaactgagttcaagggctgtaggttcatgcccaagccctgagagtgggtactagaaaaaacgagattgcacagttggagagagcaggtgtgttaaatgggactggagtccctgtgaagactgggtgaggataacacaagtaaaactgtggtactgatggacttaaccggagttcggaaaccgtcctgtgtacacatgggagtttagtgtgataaaggcagtatttcagactggtgggctagccaatagagttgggacaattgcttactcattaaaaataatagagccccacttgacactattcactaaaattaatctggaatttaaggcccaacattaaacacaaagctgttgaaatattgatgaaaatgtaagaatttttgtgaccacggggtaggagaagtttctttaaagacgtaaaaagaaaaaaaccataggctgctctgcctgtggagtagccattctttattcttttactttttaaaataataacaatcacaaaggaaagatttgccaattgaataggatcaaattctacaacttttcctaaggcacccacaaataaatgacaagtgagacaaaaagcactagtataaagattatataaagacctataaatcattaagacaactgagtttttaaaaatggacaaaatccatgaacaatttataaaatagaaatatagccaaaaatgtctaaaagatgtttatgatgtaaggaattatcaattacaacagtgagaaaccatatttccttctatccgatgagtaaaaagtttctaaagtgttggcaaggcttaggaaagtgatatgcatttcctgctggtcaagttgtaaattagtatagctactttggaggacaattgtaaaatttaaatcatatcctatgacccagcaattccatgctataaaaactcatccatggccgggcttggtggctcacgcctgtaatcccagcactttgggaggctgaggtgggcagatcacgaggtcaagagatcgagaccatcctggccaacatgatgaaaccccgtttctactaaaaatacaaaaattagctgggcatggtggcatgtgcctatagtcccagctactcaggaggctgaggcaggagaattgcttgaacctgggaggcagaggttgcagtgagccgagatcacgccactgcactccagcctggctacagggcgagactctgtctcaaaaaaaaaaaaaaaaaaaaaaaaaaaacattcaaagagacatatactaagatgttcactgtggcattgtctgtaatgacaaataagtggaaaccgtgtaaatacctgtcaatactatggagtaccatgtggcaacggaagaatgagactgaactgtgtgaactaacatgcaaagatccccaaaacaggccaggtgtggttgctcacagctgtaataacaacaccttcagaggctgaggtgagaggatcagttgaggccaggagtttaagaccagcctgggcaacatagtgagacccctgtctcccaaaaattttttttaattagctgtgcgcaattgctcatgcatagtcccagctacccaggaggctgaggtgggaggatcacttgagcccaggaatttgaagctgcagtgagctgtgttcttgccactgcactccaatctgggtgactgagcaagaccctgtctcttaaaaaaataaaaaagatctccaagcatagagaagagtctggagggaaacaccaaactcataacagtcttactgcaggcaagtgggataaaggcccagactccatggtggaagttaaagggcatttccaagttaaggctaagacttgcttttctaactaagagaatgtgctcatgcattgcttgtgtagtagaaactagtttttagaaaagaaagcaaacttaagaaacactgactcctgtggagatgacttggcaccactctcctttcacagagcagagtctgaatagtcttcagagataggcctgtgggccagattgccatcccctatggaccagaagccaaggatctctctagtgatggtcagagggcccaaatggcagggatacccagtgatgtcaggaggaatagtacagacagaaggtgctaagcagacaattcaactgccatgttttgccaccccctgtgagcagggattaggtgttcaggccagtatcttgggcatgggggagcctttggccagaagaggtataaagctcagaagtttttcagtctgataactattgatataatttccatagtgtgagggagcggtatgctctacccttgtgtatttaaggcaggacagagaaattgaggatgcccctggggctagatcgatgatatgaccagaaatcaaaaagggaatgcattatttattgctgtgtaacactgttaagagaggaggtagttaagggatggataggcacatagagagggaaggtctcaggagaagggatagaaaggaactatgttcacaagaacaacggcaagacagtgcctatactgcctctacagttaataggaaaaacggaagaagttacccttaagctaggatgttgctcagaagtgaccatcccaactttggtgcgggcacaataaatcagcctaaatgtccctaatttaacccagctcattataatgtcattaaacatgacattagcattgtggttttagcacccccatgggttttgcttaggcactcatgggtaataaccaagatggagtccctttggcaaaacttaggcatgcacagctgtagtaccccaagaagaaaatgttacttctctcatctgggcaaaacccacagaagacttcccagcttctgccacataaaagacacagaacacagacgccttactggcaacctgctttcaagacccctgtctttgctgagagctttcctttttcccaataaattctactctgccctactcactctcaaaaaaaaaaaaaaaaa

SEQ ID NO: 24 - DNA, 1372 bp, Homo sapiens
aagctggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatctgccctacttgattgatggggctcacaagatcacccagagcaacgccatcctgtgctacattgcccgcaagcacaacctgtgtggggagacagaagaggagaagattcgtgtggacattttggagaaccaggctatggacgtctccaatcagctggccagagtctgctacagccctgactttgagaaactgaagccagaatacttggaggaacttcctacaatgatgcagcacttctcacagttcctggggaagaggccatggtttgttggagacaagatcacctttgtagatttcctcgcctatgatgtccttgacctccaccgtatatttgagcccaactgcttggacgcctttccaaatctgaaggacttcatctcccgctttgaggtttcctgtggcataatgtgatggtcaattttctgcatcaacttgactgggctaagggatgctcagatggcaggtaaaatcattgtgcttgtgagggtgtttccagaagagatttgcctttgaatcagaagacagcaaagatttccttcagcaatgaaggaggcatccaccaaactgtcagggcccagagagaagaaaaagacaggaagggtgaatttgacctctctgactgggacatccatctctgcctatcctgggacctccacactcctggttctctggccttcagacttgatcagggactaacaccatcgcctcccacccccacctttgttctgaggcctttagcctctgaatgataccactggctttcctgcttctctatcctgcagtcggcagatcatgggacttcttcactccaaaattgtgtgagccaattcccataacagatagataaatttataaataaacacacaaatttcctacagcct

SEQ ID NO: 25 - DNA, 1070 bp, Homo sapiens
aaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaatatgaataaaaaaaaaaaaaaa

SEQ ID NO: 26 - DNA, 5118 bp, Homo sapiens
ctccttgctgctgctgccgccgccaatcctggtccggttgcccgagttcccggaggtctctcgcgggacctctctcaccgccaccgctcctactctcgggcttccaaatctggggcgatgtctccccaggttaaattaccctagctcctgctccagatcgcttccccgtgccccgccagagcccagtagttcaaaaattaaatttggggcaaggggtgcgcgccagagcgcagctgtttctggagcctgcggcagcggtggcgagccacagggcggcgaccgtgagctccgggagctgcgcaaaccacctggagaccatgtctggggatgcgaccaggaccctggggaaaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaaggataggaagaaaagaaagtttatacctggttaattcgtcactgaaaacaattttctgtatccttttatatatagtagactacaagctaaattttttatcatctaagttaacatgtctataaactaaattcattattactagctatttttaataagttattgagatataattcatatgccacaaaattcacccttttccagtgtacaattcactggcttttagtatattaagtgagttgtgcaactatcaccagtatttaatttcagagcgttttttttatcatcccccagaaaaactgctcacttgtaagctgtcattttccatttcttctcaatccctgtggctgtacgcagccactgatctgctttctgtctctatggattgacttattctagacacttcatataagtggaatcatacaacatgtagcatttcatgagctattttcacataccataatgttcttaaggttcatccttcattcttttttatggctaaataatattccatgtgtgaatacgcacattttgtttatccacatctgggaaggttccactcttggaactaatatggataatgttgctgtgaacaccatgcaggtttttgcatgaatatacgttgttatttctcttggatttgctagctgatttagcatgtttactaacatgccattttagttgtaaccaccattctttcacacttgggaactgattatccctgactcaggatgcctcgttaagtgtattagtgctgttgctagttgggttacttccttcatcatccaattctgacagctgctaatatttgctgtacttctttcaatagctttctgatataccctttcccatcacataaataatagaataataattattcttattatttaaaaattaattttactcttctccaattataaagtaatacttgttcattagagagaatttggaaaatacaggaaaacatagaaactaaggaaaaaaaattataatcccactacccagaaacaaccactgttattatcttggggacttttttgtttttgttttctgtccttttctgctatgtatattttatgtagttgaaacttggttactattatgatgtaaatattccccacaccccctgccattttattttgagacagggttttactctgttgcccaggctggaatgcagggtgcaatcacgcctcactgcaaccttgaactcctgagctcaagggagcctcccaactcagtctcctgagtagctgggactacaggcatgtgccaccatgcctagctagttttctttttaacttttgtagagacagggtctccctctgttgcccaggctggtgtcgaactcctgggctcaagtgacccacttgtctttgccttccaaaatgttggcattacaggtgtgagccaccacacctggccaatttttataaactctgtaaatgcttatttacatatataagagtgttccttagagcagcagcattatttgtgatgatgacaaattaggaaacaatattcattagatggtgagtggttaagtaaatcatgtctgtcttgtggaattctgtggaacggctgaaaatgaatgaggtaaatctatgtgtactgacattaaaagattgcctagaaatattaaatgaatcacacagtaatacaggtggtatgatcccattttagcagaagaaaacaaaactgaaccatgcaggtgtgcacatacatgtaaataagtggctagaaaagtatctagagagaaacacatccacctcctagtaatgtctcacactgggaagggggctgattagaattagggtgggtaagaaaagtggttaagggcagggaccgggagggaagattttgtcttttacattattttctgtgtttgattttttttttaatgatgggaatgtatttctgtattaaatatgtaagttttaaaagtagaaaaaaacacttttttttttttttttttgggacggagtctcgctctgtcgcccaggctggagtgtagtggtgctatctcggctcactgcgagctccacctcccaggttcatgccattctcctgcctcagcctcccaagtagctgggactacaggcacccgccaccacgcccggctaatttctttttgtatttttagtagagatggggtttcactgtgttagccaggatggtctccatctcctgaccttgtgatccatctgcctcggcctcccaaagtgctgggattacaggcgtgagccacctcacccggccgaaaacacttttaatgtctgcatactttgccatgtttataaaccataaagttatttatccagcacactaattaggagtgtttagatggttttcagtcctttactgttttgaatggtgctgcagggaacatcagcttctttgcataaaaagcattttctctattttagaatatgttcttaagctggactctcaggaatggaattaccagatcaaagggtataatgagcacattggaggcttggactgtatttcactaaattgcttcccaaaagacttgtgttgtttgcccctcaccagcagtatgtgaaaatgctctttgccctatatccttttcactggtgggagacttcattcaaaaagatatttgtttgttgaataatatttgctgtggagatacactgtagttcctcattgttgacttaatgcatatttctttgatggccagggaagtggaaggttttcccggaagtatgtcatcccttgctcctggtcttgcaaaatttgtctgttcagttcaggggctttgcctatctggccatcagagtcttactaattttctttgttgatttgtaaaagttccttttaaagcgttccttgtatagaaaagatatttgactggttttaaaacacatttttgttttcttttgacttttaatttggcttatatatttttgcatatggaagtacagcatttgaaagtattgtgctataaggctttccttatatgtgctatgatttcctccactgttttatgtgtaggaagtcctctccccacttcagagacttgataaatattcatttatattttcatctaccaccaatcactttacagacatttgactggtcaagcattaccctcctagcttttccccccacactatcttacaaatatattgtgatttgttttagtttttgttttttgtttttgagacagggtctcactctgtcactcaggctggagtgcagtggcatgatcatggctcactgcagcctcgacctctcaggctcaggtgatcttcctaccttagcctcctgagtgtctaggactacaggcaccactatgcctggctaattttgtgtattttttgtagagatgggattttgccatgttgcccagactggtctcgaacttctgggctgaagcgatccttccaccttggtctcccaaagtactaggataaaaggtgtgagccaccacacccagccctacaaatatattttgaagatacgaattaagctcattaaaaggatgccagcatagaattttcagagtggtcctttaatccccaaattttgacagttgtattctgcaccttcatggagaatctaggtcataactgatgggcagcaggaggggcatgttctgctgcaggtcctccctctaaggctccttcccagaggagaaaatggtcttaaatatgccctaggtttgttccacaccctaggtttgttttacagggaactgggtcatcacatggttagctcagcctcagctatatcattttagcagggatctgagatttgaaatcttaagaacctccatttatcttttatgagctcaaaacatttctgccctccaaaagacttgaatagacatttctcaaaagaagacacacaaatggcaaacagacatatgaaaaggtgctcagcatcattgatcatcagagaaaggcaaatcaaaactacaatgagatatcatctcaccccagttaaaatggcttacatccaaaagacaggcaataacgaatactggtgaggatgtggagaaaagggaaccctcgttcactggggcgggaatgttaattagtataaccattgtggagaacagtttggaggttcctcaaaacactaaaaattgagctaccatatgatccagcaatcccactgctgggtacacacccaaaagaaaggaaatcagtatatcaaagagatacctggacccttatgtttgttgcagcactgtttacaatagctaagatttgaaagcaacctaagtgtgcacgaataaggaatggataaagaaaatgtgatacaggccgggtgtggtggctcactcctgtaatcccagtactttgggaggccaaggctagcggatcacttaaggtcaggagttcgagaccagcctggccaacatggtgaaaccctgtctctactgaaaatacaaaaattagctggcatgg

SEQ ID NO: 27 - DNA, 3973 bp, Homo sapiens
gggctgggggagggtatataagccgagtaggcgacggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactggtctaatgtttgtgagaagcttctaattagatcaattacttattttaggaaatttaagactagatactcgtgtgtggggtgaggggagggagtatttggtatgttgggataaggaaacacttctatttaatgcttccagggatttttttttttttttttaaccctcctgggcccaagtgatccttccacctcagtctcccagctaattgagaccacaggcttgttaccaccatgctcggcttttgcattaatctaagaaaaggggagagaagttaatccacatctttactcaggcaaggggcatttcacagtgcccaagagtggggttttcttgaacatacttggtttcctatttccccttatctttctaaaactgcctttctggtggctttttttaaaattattactaatgatgcttttatagctgcttggattctctgagaaatgatggggagtgagtgatcactggtattaactttatacacttggatttcatttgtaactttaggatgtaaaggtatattgtgaaccctagctgtgtcagaatctccatccctgaaatttctcattagtggtactggggtgggatcttggatggtgacattgaaactacactaaatcccctcactatgaatgggttgttaaaggcaatggtttgtgtcaaaactggtttaggattacttagattgtgttcctgaagaaaagagtccaggtaaatggtatgatcaataaaggacaggctggtgctaacataaaatccaatattgtaatcctagcactttgggaggccaaggcgggtggatcacaaggtcaagagatagagaccatctttgccaacatggtgaaactccatctctactgaaaatacaaaaattagctgggcgtggtagtgcaagctgaaggctgaggcaggagaatcactcgaacccgggaggcagaggttgcagtgagccgagatcacaccactgtactccagcccggcactccagcctggcgacaagagtgagactccacctcaaaaaaaaaaaaaagaatccaatactgcccaaggataggtattttatagatgggcaactggctgaaaggttaattctctagggctagtagaactggatcccaacaccaaactcttaattagacctaggcctcagctgcactgcccgaaaagcatttgggcagaccctgagcagaatactggtctcaggccaagcccaatacagccattaaagatgacctacagtgctgtgtaccctggggcaatagggttaaatggtagttagcaactagggctagtcttcccttacctcaaaggctctcactaccgtggaccacctagtctgtaactctttctgaggagctgttactgaatattaaaaagatagacttcaactatgaaa

SEQ ID NO: 28 - DNA, 1818 bp, Homo sapiens
tccccggcaaggcccaatggggcggcaggcccggcagccccgccccggtggtgcccgcgcggccagcgcccgccaggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaaaaaaaaa

SEQ ID NO: 29 - DNA, 1404 bp, Homo sapiens
aggcgtcacttcccacgcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaagatcccatctgctgttccctctttcctgctccatccactgcccttttcatgggccatctgaatgcagaacttgcagctctccttgggggtggaacagcaagggatacaggcaggctgaagcatcagcttcaccttcacgccccatctccttttcgctgtgattctttccttccacctggtcttgtctctatttcttccaaggaaggtagccacatcctgcctctgatctgcgtttcccatcatctttgcctgctcagcctcctgtcctgccctggctgcagcacagctaatagtggctt

SEQ ID NO: 30 - DNA, 1740 bp, Homo sapiens
ggggcccagctggtcgcggtccccccctcaacatggcggcagcggtgctctaggcgccggaagggggcgtgaatcggtgcgaccgcgcgcgtgcgcagtaccgggtccgcgcctgtccccgaaacttcgcaccccgtcgaactctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatgtgaggttcccctcgcaccctaccctgctgccccgcccagtctccccctgcagcctcctgtagcccgcctcatgcactgaccacagcccccaggggaggatggtactggatctggccccatcttctggcccttagctggtgccacttccctcctgtggcaatcccagtcctgcacgtcacaggagacagcggggggtggcagggcctggtgtgtgccgagcctgcctgtgtcctacagatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctccctagaaaaaaaaaaaaaaaaaa

SEQ ID NO: 31 - DNA, 188746 bp, Homo sapiens
cctgctgttgacctgaagacttagcaataacataaacagccgattaacaggcattttgtatgttacaagtattacatactgtatttctttctttcttactttattattattattattttgagatagagtcttactgcatcacctaggctggagtgcgctagtggcatgatcttggctcactgcaacctccgcctgttaggttcaagtaattctcatgcctcagccctccagagtagctggaattacaagcacaccacgcctggctaatttttgtatttttagtaaatatggggttttgtaatgttggccaggctggtctcgaactcctgacctcaagtgatccgcctccctctgtcttgcaaagtgctgggattacaggagtgaaccactgtgcccagcctctacacactacagtcttagaataaagcaagttagagaagagaaaatgttatttaaaaaatcacagctgggcatggtgtcatgtggctgtaatcccagctccctgggaggctgaggcaggaggatcacccgagatcaggaggtagaggctgcagtgagccctgatggtgccactgcactccagtctgggcagcagagtgaaaccctgtctccaaaaagaagaaaaaaagaaaaagaaaaagaaaatcacaaggaagagaaaatacatttacagttacagaacgctacaatatttatcaatgccataaatttgtttacaagatgaattgtctgtctgaagcagacaaccgcagctgtagagctccatttatgttacgtagcaagcaattcaactttttcttgtcctgtcctgacttttctctgcttctcgggagcatttccagcatcactagtggcactttacatgggtctcaggatgttattcaatgtttgcggtattgcactaaacacagtgaaaaatacgcgggaaccgccaagagatccctttttaccggggcacaaattcctggagaggtgaactgcccacagggagataattaatgtaacatggcatttaaagcggatacttgcaacacttgcactcactccagtagcaacaggaggtggctatgaaattgttacaataacacaatatattctatagttaattttatgcagttatgattgaatgctgcatctttacatttatttacatttctcttgacttggaataacaccatgtatggtttgtaagtgtgtgtgtacgttttaatacattttaactttttgtaacagatttgtgtatattttatgttagcaaattataaaatagggctggacatggtggcttatacctgtaatctcggcactgtgggaggtagaggcaggaggatcacttgagttcaggagttagagaccagcctgggcaacatggtgagacctcgtctctataaaaagtaaaaaaattagccgggcgtgttggtgcttgccaggaagatcgcttgaacccaggagttggaggttacagtgagccatgattgggccactgctctccagcctgggcaacagagcaagaccctgtctctaaaagaaaataataacaaaaataataaaacagactagtatctacatatattttatgcattcatgacatacctaatttttttttaatatttcttggctaccaagttcatctgcaagtcttttcaaactattgcaaatctctaaaaatgtttccaatatatttattgaaaaacattctgtttaaagatgacctcactttgggaggctgatcagatcagctgaggtcaggagttcgataccagcctggccaacatggtaaaatcccgtctgtactaaaaatacaaaaattaaccgggtgaggtggcgtgtgcctgtagtcccagatacttgggaagctgaggcaggagaatagcttgaaccctggaggtggagattgcagtgagctgagattgctccactgcactccagccagggtgacagagcgagactctgcctcaaaaaaaaaaaaaaaaaagatgtgcacggttcaaactcatgttcaagggcccactgcagttctcacccatggcttcactttctcctctttcttttctgcagctacagtgaatgcctggttcagttgcaagaatgccttgcccactctcctctgggcctttgctcatgccttcccccacctgaaacacatccctatggcttccctaggatggctcctcttcattttcagacttaagctcaaaatcacatcctcagtcaggtgcagtggctcacgcgtctgtaatcccagcaattagggagaccgagacaggcagatctcttgaggtcaggagttcaagaccagcctgtccaatatggtgaaaccctgcctctactaaaaatacaaaaattaggcaggcgtggtggcatgcacctgtaatcccagctactctggaggctgaggcaggagaattgcttgaacctgggaggcggaggttgcagtgagccaagatcgtgccactgcactccagcctgggcaacagagtaagatccatcaaaaaacaaacaaacaaaaaaccccatgtcctcagcaaacccctccctatgcacctcccatttccctcagctcattacacactcaattattttaagggctctctccctggctcagttgtgaactccataaggaaatgggtcatgtttattttgctcactgaaaaatcccctattacttattgcttgttgattctcccactcaacaaatatttattaagcaacagatttgtcaggcactgggtttaagcagtgaaacaagaccgaaaagatttccgccttcacgggaaggggagaagacacagaaaacgaataagaatttcaaggccaatcatggtggcgcatgcctgtaatcctagcaccttgggaggccaaggcaggaggattgcttgaggccaggagttcaaggctgcagtaagctaggattgcaccactgcattcctgcctgggtgacagcaagattctgtcaaaaggaaaaaaaaagaaagaaaagaaaaaaaaaaaacaaacaattgcaggtagtggggtaaacatgctatgaaaatgagagagaaggggccaggcgcagtggctcaggcctgtaatcccagcactttgggaggccaaggccggtggatcacctgaggtcaggagtttgagaccggccaggccaacatggtgaaatcctgtctctactaaaaatacagaaaattagctgggtgtgctggcgcatgcctgtaatccaagttacttgggaggttgaggcaggagaatcacttgaacccaggcaggtgatgttgcagtgaactgagatctggccattgcactccagcctgggcaacagagaaaaactccatctaaaaaaaaaaaaaaaaaaaaaaaaaaaaaaaaaaaaaaaaaaacagagagagagagagagagaaggaaacggaactggggggaggatttgcaaaaatatggttagggatggcacttcagagatgaagccatcctggagtgttacgggcaagggaaatgctggggcaaaggcccagaggcaggaataggtttggcctgttgcatgaacagtgggtccagctcctagcaaactgtttattgaatgaaagaagaatgaatgccttgggtctagggttgtgctgggcgctttcttaagttttctttcccgggtacctccccagaactggcatgcaggtattattaaacccattacacaagtgaaactggcccagagacagaaaagtccctggtccaagaccacacaggagtgaggggtggaggaaccctcctcccattgagttctggctttcctatactgaaagccccttcctctcctgcagtaaggtaggtggaaccgctgtcccgccttgttggtgaatgtcgttgctagacttcagacacatacaggctggtctgctgaaaatcagagatgtccacctgcgccctattcgaggtctccggcgtcttctttggcgtcgtctttgccctttcagaagcgtctgcacatttttccaggtgtcatttctccaacttgaacacagggagcgcactgggcacgcgggcacgtggctgtccccaggggcctggcttgggtctcgcccctgggccggggcgcactcgcgggcgggacatctgggggcgcccacgcgctctgggacgagtgtcgctggccaggcccggactgaggaaaggcgagtgagacactactcgcctggggtgcaaaatttaagggagtgaaaaaaaaaaaaaaagaaagaaaccaaaaccacctcgagtcaccaaaataaacattttaatgcagtattttttaaaaaatcaacaggaatcctccaaagcccactatgaacaaaatagcaaaatggtagagaaaggatctgtgccgctgcgtcgggcctgtggggcgcctccgggggtctgaaactggaggagactcggggctgtagggcgcgcggatctggggcgcgccctcggtcccggcgcgcccagggcctcccgcgcggggcccggcacagggaggcggggaggcgggcggggcggggcggggccgggcggcacctccctcccctgcaagctttccctccctctcctgggcctctcccgggcgcagagtcccttcctaggccagatccgcgccgccttttcccgcggcccgcacggggcccagctgacgggccgcgttgtttacgggcccgagcagccctctctcccgccgcccgcccgccacccgccagcccaggtgcccgcccgccagtcagctagtccgtcggtccgcgcgtccctctgtcccggagcccgcagatcgcgacccagagcgcgcggggccgagagccgagagacagtcccgggcgcagcgcggagctccgggccccgagatcctgggacggggcccgggccgcagcggccggggggtcggggccaccaccgcaagggcctccgctcagtatttgtagctggcgaagccgcgcgcgcccttcccggggctgcctctgggccctccccggcaggggggctgcggcccgcgggtcgcgggcgtggaagagaaggacgcgcggcccccagcgcctcttgggtggccgcctcggagcatgacccccgcgggccagcgccgcgcgctctgatccgaggagaccccgcgctcccgcagccatggccaccgggggccggcggggggcggcggccgcgccgctgctggtggcggtggccgcgctgctactgggcgccgcgggccacctgtaccccggagagggtgagtctgggggcgcgggcgtgggcggggagcgccgcgatggggagaggaccccacccaagccaaaatcgagcccccgcttgtggactgagaaccctccccaggggcggggggcggtggccaggacggtagctcctgcatcgcgtagggggagcgggaagcctctgaccttggcctttgcccgcccgggctcgcgcctccgcgccctgcgtgcccgacctgagcccgaggaaccttgccccggtgcccgccccgccgcgggctcctctctggagcgcgcctccgacccgtgccccggcccctccgagcccaagtcgctccggagacacgacacgcgtcatctttgggtcgcggccgggaagtggggtcactgggtctggacagccccgaacagccaagtcccccgagcgcatatggtgtaggtagagccaagcgccctgagtgcctcaccggtgggtgacgctgcctggggtcagggactgcagagcccccctctacccaactaccttggatctaggcccgtggccaccccggactctaggtccatgtttacccttttgggttctgtttccagatgtccggaggcaaattctaaagccttagcaacagcagcaattgtagcagaagtagtggcggttttttaccctatttattgtaattggtatcaccgcacgccacagcctagtctatcttatctctctggactgtcacagtggcccccggaggcagatacagttatgcacccatttcacagaggagtaaactgaggctcatgtaggacgcataactcccttgccctaaagtcagtgccagagccaggacttgagcctctgtgtgtcccgttctgcccaagaatctggactactgtcccttgtctgctgtctccttgacccctcctctcccctcagccctgcgcttcatgaaggagcctttgaccttgagtgagcctttcgttccccctgaccccatgggcccctctcccacgtgtgggcagcatcttccttgggcttgacaataggcacctttggggttgtaagatgaagatggcgcaatcatttaaggaatatagcctgggtttcccactgtggggtctgaggccctgctttaaaaatatctgttgggttactgtttcagatttctccataaaaggaaatcagtcgtgatgaggaaggggtcagggagggaaggaattgaagctcttaaatgtattgatggggaaacgggtgcatgtaaaatcaggtgctagagtggaccaaccgggtttgctgagtcgactctgtcaatcacataatgtctaaaagccccgggcccacccccccccagccccgcccccaggtgcctgggagacagtaggtgctcaatgaagggtggcggttagttggagttcttgttaagaaaatctggccagctgcggtggctcaagcctgtaatctcagcattttgggaggctgaggcgggcggatcacgaggtcaggagatggagaccatcctggccaacatggtgaaactcccttctctgctcaaaatacaaaaattacctgggtttggtggcgttcgcctgtagtcccagctacttgggaggctgaggcgggacaattgcttgaacccgggaggaggaggttgctgtgagctcagatggcaccactgcactccagcctggccaaagagcgagactttgtctcaaaaaaataaaaaaaaaggcggggcgtggtggctcacgcttgtaatcccagcactttgggaggccgaggcgggtggatcaccagttcaggagatcacgaccatcctggctaacacggtaaaaccctgtctctactgaaaaatagaaaaaattagccgggcgtggtggcgggcgcctgtagtcccagctattccggaggctgaggcaggagaatggcgtaaacccgggaggcggagcttgcagtgagccaagatcgtgccactgggcgacagagcgagactctgtctcaaaaataaataaataaataaaaagaaaatccaagatgagtggtttcgaactatgccagattctatgtgtgcgtgtgtgtggttccctgttcttctgttccttgtagctttggtaattaattgtggatctgtgcctgggctttcagggtcagtaaatggatttaccatttctttgcacatttatggcttccatatgggcaggggtttatggtttgttgttgttcaccgttgcatttctagagcccagaacgatgcctggcacatagtaggtgttcagtaaatatttgttctgcagtggggcacaagtggtggagttcctgggtgtactgggctcctttatcatcttaaggagttccttattctctgcataataccttcctaagaattagaagagcaagctctcagcaggtgctgttctatgcgctttgcatatataatctcagttaatcctcacggcaaaaccccacgaggtgcggtttaatcttcccttttcacaagtgagaaaacttcgcttgaggccagcaggcagcagggctgggattgcaatctagctagtgtggctgcagagcaatggtttcttaacaaatctttgttcttttgagtccgagcctccgtaccccccacgattggggtgatggtgaacaaaatcctgtcaaataaatgggctgtgatgcctcttgaaggcttggggaggggcaaagaacttttcagatcattaatctctaatgtcaaccaatatggcttttttttttttgagacggagtcttgctctgtcacccaggctggagtgcagtggcacgatctcagctcactgcaacctccacctcccaggttcaagggattctcctgcctcagcctccccagtagctgggattacaggcgtgttccacaacaccggcttattttttgtatttttagtagagacagggctttgctgtgttagccaggatggtctcgacctcctgatcttgtgatccacccgcctcggcctcccaaagtgttgggattacaggagtgagccaccgtacctggcctttttttttttcttttttttttttgagacagggtgtcactctgtcacccgggctggagtgcagtgacacgatctttgcgacctccgcctttcaggttcaagtgcatctcctgcctcagcctcctgagtagctgggattacagtcgtgtatcaccacccttggctaatttttgtatttttagtagagatgggatttcgccatattggttaggctggtctcaaacttctgacctcaagtgatctgcctgcctcggccttccaaagacctgggattataggtgtgagccatcactccgggcccaatatggcattttgattgggatgaagggtggaggaaaatcagtgtgatttttgtatctatctctctagctatctattattttttgagatgaggtcttgctctgttgcttaggctggagtgcagttgggcaatgatggctcactgcagcctcgacctcctggacgcaagccatcctcctattttagcctccgtagtagctgggaccacaggcacacgccaccctgcctggctaatttttactttaatgtgtagagctgaagtcttgctattttgtccaggctggtctcaaactcctggcctcaagcgatctgcctgccttggcctcccgaagtgctgggatcacaggcatgagccacggtgtctggcctctgcagttattcttattctttgcttctctcctggagacctgcttcttgcccttccccattcatgcatagagaccacagggtgtgggctgagtccccagggctccccacctcaccccactctacccttgacttccattcctctttggtttaagcagaactctcaatcttggcactgctgacatttggggctggatcattcctggtggtgggggctgtcctgtatgtagagtgttgagctggaaccatggtctccacccatgtggtcctgggaggatccccttccccccaggcatgacaaccactaatgtctccagacattgccaggcacgtctctgcaggagttaaccttttccctgtctgagacatttacccatctgggctcttgctctttctcctctctttgttcaataatcctcggccgggtgcagtggctcacgcctgtaatcccaacaccttgggaggctgaggtgggcggatcccctgaggtcaggagtttgagaccaccctggccaacatggtgaaaccccatctctactaaaaatgcaaaaattagccaggtgtggtggcgggtccttgtaatcctagctacttgggaggctgaggcaggagaatcgcttgaacctgggaggcagagcttgcagtgagccgagatcacaccattgcattctagcctgggcaacagagagagactctgtctcaaaaaaaaaaaaaaaaaagaaaagaaaaaagaatcttcatttacccacgtgctttttcagcctctaaacacccagtaccccccaatccccattacctaccactgacctccagcctccaccctgtccagcttccccaggccagtcctccctgccctttccatctcactcttttctcactgttctgcccccagcatctggcttgcatctccgctgctttaccgatggctctcgaagttaatctctcatctcccagttgcgtctcctgcagcctcacctcacttgacccctctgggtttgacattgccagtcccccctcctggaaggctgtgtctcccgtctcacctgtgcctaagttcttctgttttactgttctcttctccttctacctgggctaagatgttggctctctcttcccagagggtcagtgtttcctttaatcttctctcagctcacttttttttttttttttttttcacttcttcacccgggctggtgtgcaatggcatgatcttggctcactacaacctccgtctcctgggttcaagcaatggtcctgcctcagcctctccagtagctggaattacaggcatgtgccaccccgcctggctagtttttgtacttttagtagagacagagtttcaccccattggccaggctggtcccaaactcctgacctcaagagatccacctacctcagcctcccagagtgctgggattacgggcatgagccaccgtgtccggccctttttttttttttttttttttccaatttttatttctttttagagacaggattttgctctgtcacccaggctggagtgcagaggtttagtcctagcttactgcagcctccaagtcatggcctggagcagtcctcccacctaggttccccaagtagctggaatcacaggcaggtgccaccatgcccagctaattgaaaaatttgtttgtagagacagagtctcactatgttgcccaggctggtcttgatttcctggcctcaagtgagcctcctgccttggccttctgagaaactaggatcacaggcaggcaccaccatgactagctaatttttaaaatttatttgtagagacagagtctagctatgttgcccatgctggtcttgaattcctggcctcaagcaacctgcttgcctccgcctcctgggtacctgggctcacagacagtcaccaccatgcctggctaattaaaactttttttttttttttgtagaaacagggtcttgctatgttgcctaggctggtcttgaactcctagttcaagcagtcttccctcctgggcctcccaagtgctgggattataggcatgaggaaccattgcgcccagctaagaaatttacatagattccgacttcttcatctgaacaggggtcagcaaactatggccctcaggccaaatcccacggtttttgtaaatgcagttttattggcatgcaaccacactcatttgtctactcatcatctatgactgcgcaaaaatgccccgacacggcaggttgagtagttaaaacaggaattccatggccaaaatatttacactttggccctttacagaacagcgtttgctgacctctgatctggaacagacgccttgaggtttcattcatgatagcatgcctaatagcttgtgcagtccctggtacaactcgaatgaagtgagtgaaatgaaacgctatgtctttctctttacaccgcaagagatgttaaagaaacgtgtgtcatttgctgcactgaatatacggattccaaggatgagaaaaatcaccgtgatgttgcctacttagccatgtgtatttatttaaacagctatattggcattgaatgaggatttcatgctctcaaccctgtatctagaacccaaaatataactggtgtatataatgagattttttttttttctctcaggcctctcttgtgttaatttctgttaagaatacttctgggccaggtgtggtggctcacgcctgtaatcccaagcactttgggaggccgaggtgggtggatcacttgaggtcaggagttcgagaccagcctgaccaacatggtgaaaccccatctttactgaaaaaatacaaaattagccaggcgtggtggcgcatgcctgtaatcccagctagttgggaggctgaggcaggagaatcgcttgaacctgggaggtggaggttgcagtgagccgagattgcgccactgcactctagcctgggtgacagagcgaaactccatctcaaaaaaaaaaaaaaaaaagaatatttttggccaggtgcagtggctcatgcctgcaatcccagcactctgggaggctgaggtgggaggattacatgtgtccaggagtttcagatcagcctggacaacacagcaagaccctgtctccactaacaataaaacaaaaattagctgggcatggtggcatgtgtctgtagtcccagctacttgggaggctgagatgggaggacctcttgaggctggaagggcaaggctgcagtgagctgtgattgtaccactgcactccagcctgggcaacagtgagatcctctctctgtctcaaacaaaaaaagaatacttcttggggtggcctggttgatattttgcagctgcatggtatttacagtttttaattaaatagtgacgggtaatgcattctcattgcaaaaagaaaaattacaaaagtgtagaaaggaaaaaaaaaacacagaagtccttctgcaaaatcttgtggtggggtgcagtggctcacacctgtaatccctggactttttaggaagctgaggtgggaggaacacttgaagccagcagtttgagaccagcctgggcaacataatgagacattatctctagaaaaagtttaaaaattagctgagcatggtggtgtgtaccggtagtcccagctactcaggaggctgaggtgggaggatcgcttgagcccagaaggttgaggctacagtaagccatattcatgccactgcactccaacctgggtgatagagcccgaccctgtctcaaaaagaaaagaaataataaaaaaaaatcttgtccccctgtccccaaaagcattccattcatgtccagggaggtaactgtgccattggtttatgtatctttttgatgtttagtaattttttaggctaggtgtcatggggccactcctgtaatcccagcactttgggaggccgaagcaggtggatctcttgagcccaggagttcaagaccagcctgggtaacatagcaagaccccgtctctacaaaaccctacaaaaaaattatccagatacagtggtgagcacctgtggtcccagctactagggaggctgaggtgggaggatcacctgagcctgggaagtcgaggcgccagtgagctgtgattgcaccactgcatccagcctgggtgacatagtgagactgtgtaacaacaacaacaacaaaatattttaaacattatcatacagtaaaattggctttttaaaggtgtaccattttatgatttttaagccatgtgtagagttgtatggctattgccacaattaggatagagaacagtctcgttgttgtccaaactccctcaattcacccctttatcactaaaccacctccacccctaaccacagatctgttctccatccctatagttttctctagactttaaaagattttatcttataattggattaatattcctaaagttgaaattttaaatttgagtctggttgatcctcatcattcccagatcccatattttctttttaaaatttaaaatttaaatttttattttgagaggcaggttcttgctctgatacccaggctggagtgcagtggtgtggtcctaattccctgcagcctccaactcttgagcatcaacgatcctcctgcctcagcctcctgagtagctgggactacaggcacacaccaccatgctcagctagtttttattgttatttatttatttatttatttttgagacggagtctcactaactctgttgcccaggccagactgcagtggtgtgatctgggttcactgcaacctctgcttcctgggctcaagcaactctcctgcctcagcctttctagtagctggggttacaggcacgccaccatgcccggctagttttttttatttttagtagagatggggttttaccatgttggtcaggctggtctcaaactcctggcttcaagtgatccgcccacttcagcctcccaaagtgctgggattacaggcgcgagccactgtgcccggcctaatttttaacttttcagcagggataagggctcgctatgttgcccaggctggtctcgaactcctggcctcaagtgatcctcccatcttgacttcctaaagtactgggattacaggcatgagccactgcacctggccccagaccctgtatttttgaattcacctactcactcaaatgtatttgtaaccctcaaaccagcatgctcagtgcctttctggtcattttaggacactcataagtacgagtctcaaatgtgaggtcaagtaagagggcattccaccttcttgcttcagcccttatgcgtcagattcatacaatctgcacactgaggattaaaactagtcctttttgagcaggcgcagtggctcatgcccagcgctttgggagtccgaggcgagtggatcacgaggtcaggagatcgagaccatcctggctaacatggtgaaaccctgtctctactaaaaatacaaaaaattagccaggtgtggtggcgggcgcctgtagtccgagctactccggaggctgaggcaggagaatcacttggacccaggaggtggaggttgcagtgagccgagattgtgcctctgcactccagcctgggtgacagggtgagactcaaaacaaaaaacaacaacaaaaaaacctgagtcctttttgtggttatttggtgccacatttttagcatttttgtgctttcagttggtgatggggctgtttcaaatgccccccagggtgctgaagccctgctctctactcttccttggctaaggagggctgtcaccacccttgtggagaaaaggcagcgtggcggggcacggtggctcacatctgcaatcccagcactttgggaggttgaggcaggtggatcacttgaggccagagtttgagaccagcctgggcaacatggtgaaaccccatctctactaaaaatacaaaaattagctgggcgtgatggcgcacacctgtaatctcagctacctgggaggctaaggcacaagaattgctcgagcctaggaggtgaaggttgcagtgagccaaggcggtgccactgcactccagcctgggcaacagagtgagaccctgtctcaaaaaaaacccaaaaaaacaaaaaaactccaaaaccaacacacacacacaaaggcatgtgttacataaactttgttcaggcatgagttctattactgttggccgtgagttcggtgttaatgaatcaacaatatagattcaatagtgtctttcaacagaaacacacataaaacaaggctaggtattgatccatggataaatgtgttgtggccagaagttcgcaggtacttaccctcgcattttcctaggaacaatggttcagtattcactagttcaacattcaggggaatttcacagagccaaactaccaccaataacaagaatcggctgcaagtggtttaaaactggtgaatctgtggctcatacccgtaatcccagcactttgggaggccgaggcaggtggatcacctgaggtggtgagttcgagaccagcctggccaaaatggtgaaaccccgtctctactaaaaatacaaaaattagccgagcacggtggctcatgcctgtagtcccagctactcaggaggctgaggcgggagaattgctggaacccgggaggcagaggttgcagtgagccgagactgcaccactgcattccagccagggcaacagagcaagaccccatctaaaaaaaccaaaccaaaccaaacaaaactgtgggtttgtcattttccgtttagaatcctttgaatgcaaatgccctttttgttgtattttcatctgcgtggaaaccgctgggttgataccttttggaaagttcatgagatgtccaaaaacccctggcccatgtttcagggaggggaatccctgccctctgccaacactggtggcagggagaggcagcagtggctctcgggattttatttatttcatttattcatttacatttttttgagaaagggtcttgcactgttgctcaggctggagtgcagtggcgcaatcacagctcactgcagcctcgacctcctgggctcaagtggtcctcccacctcagcctcctgagtagctggcactacaggcgtgtgctaccacgactagctaatttttgtattttagtagagatggggtctcaccatgttgcctattattattattattattattactttttttgaggcggagtctcactctgtcgcccaggctggagtgcagtggcgtgatctcagcttactgcaagcttcgccttccgggttcatgccattctcctgcctcagcctcctgagtagcagggactacaggcgcccgccactgcccccggctaattttttgtatttttagtagagacggggtttcaccgtggtctcgatctcctgacctcgtgatcccccacctcggcctcccaaagtgctgggattacaggcgtgagccactgcgcctggccatgttgcctattattattattattttgagcagtcttactccgttgcccaggctggaatgcagtgtcacgatctcagctcactgcaacctccgcctccagggtttaagcaattctcctgcctcagcctcctgagtagctgggactacaggcatgtgccaccacgcccagctaatttttgcattttagtagagatggggtttccccatgttgcccaggtgggtctcaaactcctgacctcaagccacccacctgcctcagcctctcaaagggctgggattactggtgtgagccaccttgtccagctggcttgaaggattattattattattactattattttgagatggagtcgcactctgttgcccaggctggagtgtagtggcacgatctcggctcactgcaacctctgcctcctgggttcaagcaattctcctgcctcagcctcccgagtagctgggattacaggcgtacaccaccacgcccagctaatttttgtatttttagtagagacagggtttcaccatgttggccaggctggtcttgaacccctgacctcaaatgatccacccacctcggcctcccaaagtgctgggattactggtgtgagccaccgtgccccgccggctcgcggggttttagaaacatattttgtttccagcagaacaagctttgctatcctgcggtgccacgtacagactggctctaagctcctgttggagttcaaagcggacttgtgggaatgaatgtttaatttcacatctggcattttcttccagttccttagaagtaggatatctcatcaggtttatataaaagcccctgatgtatgttcaggaaaggcaggatgctatcatgagattcttatttcctttgcctttgtgggaatgtggaaaccataggtactgtctaaaaattaccctttttatcaatgcaggcaaaagtagtcagacaggaagggactcgagagtagggatgcaactgcttttttaaattgattttaaaatctcatttattcttatcattagagacagggtcttgctctgtcatcccggctggagtgcggtggtgtgattatggctcattgcagccctgaactcctgggctcaaatgattctcgcgcttcctcctcccaagtagctgggactacaggcatgcaccaccatgcctggctagtttttttatttttattttttgcagagacagggtctggctgtgttgcccaggctggcctcgaactcaagaccttaagtgatcgtcccgcctcagcctcccaaagcactgggattgcagatgtgagccactgtgcctggtgggatacaactgttttctgactgcctgtgtatgtgtctgtgtgtgtgtgtgtgtgtttgtttgttgttgtcattctactctcaaggatgtatcttgttgtttccttgcagaagatcagaaaagggaggacctcatatgttccctcctaattatacccagttacacggtctccataccacctgttacaaagtgactttctggtctggcaggacttctcttgtttttcctcctgtcttctgtgtcctgtctgctcttgtctgtataaatttcaggactcctgaaatagcacggaagcccccttctaatcctgtggtttgatgtttgatattgttaggattacaaaactatgtcatagactagaggagtcagacattccagagttcacagaaggtgttggtgtccgggtggctgtgggacacaggtgcccttcctagtccctggcctttcatactgtgccccctggagcccctctttctttcttttttctttttttttggagatcgagtctcgctctgtcacccaggctggagtgcagtgcagtggcacgatcttggctgattgcaacctctgccttccaggttcaagcgattctcctgcctcagcctcctgagtagctgggattataagtgtgcaccacaatacctgactaatttttgggttttttgtttttttttttgagatggagtttcgctcttgttgcccaggctggagtgcaatggcatgatatcggctcatcacaacctccgcctcccgggttcaggcgattctcctgcctcagcctcccaagtagctgggactacaggcatacgccaccatgcccagctaattttgtattcttagtagagatggggtttctccatgttggttaggctggtctcgaactcctgatctcaggtgatccacccgcctcggctgcccaaagtgctgggattacaggtgtgagctaccatgcccggcctggctaattttttatatttttggtagagacgggtctcaaactttggccaggctgggctcgaactcctgacctcaagtgatccacctgccttggcctcccaaagtgctggaattacaggcgtgagcaaccgcacccagcctttgttttgttttgtttttttgttttttgttatgagacggagtctcgctctgttgcccaggctggagtgcagtggcgcagtctcgactcactgcaagctccgcctcccgggttcacgccattctcctgcctcagcctcccgagtagctgggactacaggcgcctgccaccacgcccggctaatttttgtatttttagtagagacggagtttcaccttgttagccaggatggtctcaatctcttgacctcgtgatccgcccgcctcggcctcccaaagtgctgggattacaggtgtgagccaccgtgcctggccttgttttgtttttgagacagggtctcctcgcactgtcgcctaggctggagtgtagtggtgtgatgtcaggcctccgcaatctccacctcccaggctcgagcaatcctcaacctcccgagtagctgggactacaggtgcacaccaccacacccatccaatttttttttttttggtagagatggggttttgctatgttacccaggccaatctcaaactcctgggctcaagcagtccacccacctcagcctcacaaagtgctgggattccaggcgtgagcctctctttctatcattttcttctctcagttgtctccgtgctacctttcctgcaatatcacctgttgtcactgcgtccaccagcatccgtacctgttcccccatcttcccaatgcccacgggacccacatccctgagtatcccaaagccctcacagactcaatatgctgccaactcagcctgttgttcttgccactctaaactgttcctatctcgaatgcttcaggctcattgacgatccctcctcactctcttctccctcttctcttccatttctcctgggtatgaagtcctgttcacacaaactgcccctggtttctgtggtgctatgcatgctgtcttcagtaccttcttcattctgctgccagaaggctgtttctctctttcttttttattttttaattttatttttatagacatggggtcttactgtgttgcccagattggtctcagacttctggacttaagtgatcctcctgcgtcagcctccccaagggctgggattatagatgtgagccactgtgccctgtctagagggatatttattttattttattttattttatttcttttctttttttgagatggagtgtcactctgtcacccaggctagagtgcagtggcgtgatctcagctcactcaacctctccctcctgggtttaagagattgtcctgcttcagcttcctgagtagctgggattacaggtgtgcaccaccatccctggctaatttttgtatttttagtagagatgaggtttccccatgttggccaggctggtcttgaactcctgacctcaggtgatcctcccacctcaggctcccaaagtgctgcgattacaggcatacgccaccataccggactcatttttgtatttttagtagacatggggtttcactttgttggccaggctggtctcaaactcctgacctcaggtgatcctcccacctcagcctcccaaagtgctgggattacaggcacacgccaccacaccaggctaattttcatatttttagtagacatggggtttcaccatgttggccaggctggtctcaaactcctgacctcaggtgatccaccccccttgacctcccaaagtgctgggattacaggcgtgagccactgtgcccagcctgtgtggctctcttttggttaccctgtggtatcctgttttctcaagctcatcctccctggtgggtccatgatccctggaaattgttggtcttctccggccttttgaaattgctgccttatgaatgtccagagttgggtatctgcctttctctcccaaggaggaagaatcctgagggggcatctttgcttttaggtcccagggctttcactgacttcctccttgctggcttcttggtttgttccaaagatgtcctcggtacatcttctgagactaatgacatgataagtttctggaaggactatgatctggatgatgagggtttcatcacagtcctctttcagttctgtcctacagattacacttgttttcttccttcatcctttgtcttcactggttcactgtttccatctgcattcttctgttctcatttctttttgttgttgttttattttttattttttaatttattttttaatttttttgagaccgagtctcactctgtcacccaggctggagtgtagtggcacagtcttggctcaatgcaacctctgcctcccaggttcaagtgtttctcctgcctcagcctcctgagtagctgggattacaggcgagcgctaccgtgcccggctaatttttttgtatttttagtagagacggggtttcaccatgttggcctggctggtctcgaactcctgacctcaagtgatctgcccgcctgggcctcctgaagtgctgggattacaggcgtgagccaccgtgtccggccttggttttttttagaaatagtgtctcactctgtcacccaggctggagtgcagtggtgcagtcatagctcactgcagcctcaacctcttgggctcaagcaattctcctgcctaagcctcctgagtagccgggagcacagacgcgcctcaccacgcctggctatgttttgtatttttagtagaggtagggttttgccagttgcccaggctggtcttgaactcccggactcaagcagtccacccgcctatgcctcccaatatgttgggattacaggcatgaccactgcacccggccaacatctctgcagttctttgttttagtactttgtcctttagctctggtggtagcttatcacagttatttaggtgcgtctttcctttacttgctgtaagagtgcaaccttatttgtcttgagagtccccctgggcctggcacaatgtctggcccaccgagatgcccagcaaacgtttgctgagtgaatacaggaatgatttccatgtagctgacttgccgggtccagaacctgcatttgatccagacgcctccattccttctcgcagaggtagatttgaaagctattcttgcaggcaggtggagaatcttaaggatctctgacaccccagtgtgtccaagctctaatttctggaggtaataaatctgggaatggattccatctggctcagatgggagacagaacaggtatacacagccagagaccccagttctcatctcttctttgtaggtttcattatgctgttgtcatcatttaaaggaaactgaggccaggcacggtggctcacacctgtaatcccagcactttgggaggtctagacgggtggatcacctgaggtcacgagtttgagactagcctggccaacttggcaaaaccctgtctctactaaaaatacaaaaattagctgtgcgtggtggcgggcgcctgtaatctcagctactcaaaaggctgaggcaggagaatcgcttgaacccgggagatggaggttgcagtgattcgagatcacgctactgcactccagcctgggagacagagtgagactccgtctcaaaaataaaaataaataaatgaataaataaataaaaaggaaactaaggcgtgcagaggggttgaagatgttgtccaggatcacacagttgacaggtgacagagctgggttgggaagccagattcgttagatttctagtgtgccccaaaactggtataggtggtggcctgacaccagaacccaagacttgttgaggcaggacctcctgaatttaagaggaagcagtttgaggactggaaagaatgtggaaagggacgtgtgggccccagaataggtcagcagggagcattttaagaatgctgttactggccgggcttgatggctcacacccatactcccagcacactgggaggccgacgcaggactgcttgagcccaggatattgagaccagcctgggcaacatggtgaaaccccatctctacaaaaaatacaaaaattagccaggcatggtggtacgcagctgtagtcccagctacttgggaggctgaggcaggaggatcacttgagcccaggaatttgaggctgcagtgagctatgattgcaccactgcactccagcctgggcaacatagcaagactctgtctcaaaaaaaaaatcctgtaactgaagaacaaggacctttatgattgaaaacaggaagtagaaaactcttagcattgtaaaggatttcagaatcttctagaaagttctttctctgccctgctcccaacccatctcccctgctgttttcatgatggagagaaaatcagggaagaaaggaacacttcctaagatggctctcatgtccgccttctctccttctggaaaattctcagattcaggaccagcacggtccaatacagctctgctttgatggaaatactctgtatctgctctgtccaatatggcagccaccatccacgggtggctcttgagccctggaagttgtggctggtaagactgaattctttttttttttttttgagatggagtctcgctctgtcatccaggctggagtgtaatggcacaatctcggctcactgcaacctctgcctcccaggttcaagcgattctcctgcctcagcctccctagtagctgggattacaggcatgcgccactcccccgaccccgctaagttttgtatttttagtagagacggggtttcaccatgttatccaggctgatctcaaactcctgaccttgggtcatccacccgccttggcctcccaaagtgctgggattacaggcgtgagccaccgcacctggctgaaactgaattttattttcactttaattcattgaaatgtcaatgtaaacttttatttaattcatggaaatgtaaaaaaaattagtactcagttctgttactggaaaactctcccatatatttggaacaacttggttatgtgaacttgaggtagtaggcgggactcgtctccagaggcggggatccagccctggaccaaatggaggactagccacaaggacagggctggccgggcgcagtggctcacgcctgtaatcccagcactttgggaggccaaggcaggtggatcacctgaggtcaggagttcgagaccagcctggccaacatggtgaaaccttgtctctactaaaaatacaaaattatctggatgtggtagtgcatgcctgtaataccaactactcgggaggctgaggcaggagaatcacttgaacccaggcggcagaggttgcagtgagccgagatcatgtcattgcattccagcctgggcaacagagtgaaactccctctctgaccaaaaaaaaaaaaagtgctgtctaacaccaccagctcaccctcgaattctttcctgggtgaagccaaaaaccctcccggggtaaggctcaattttggggcttgcctcttctacatcaaacctacattttcgatgatactctttataaaatctacatagacaaatcaattttttttttttttttttgagacacagtctcactctgttgcccaggctggagtgcagtggcctgatcttggctcactgcaagctccgcctcctgggttcacgccattctcctgcctcagcctcccgagtgtagctgggactacaggcacctgccaccatgcccagctattttttttttgtatttttagtagagacggggtttcacatggttagccaggatggtcttgatctcctgacctcgtgatccacccgactcggcctcccaaagtgctgggattacaggcgtgagccaccacgcctgggcgacaaatcaattatttttaaagaaaaatgagcctccgtttcgagatgggctgccagggtaaagcacacaccacatctcgtaggcgtcatgggaaaaaaatcctgcagaccagggatccccaacccttaggccacagaccagtagcagtccatgtcctgttaggagctgggctgcacagtagaggtgagcagagggcaggtgagcattgccgcctgagctccgcctcgtgtcagaacaatggcagcattagattctgataggagctcgaatcctgtcgtgaactgtgcatacaagggatctaggttgcctgctccttatgagaatctaactgatgcctgaggatctgaggtggaacagtttcattctaaaaccatcaccacccatcccgtgttcgtggaaaaattgtcttctaccattggtccctggtgccaaaaaggttggggaccactgctgtggactatctcattaatcattttttttttaggattgattatatgtgggaattatttatttatttatttattttgagatggagtcttgctttgttacttaggctggagtgcgacgggatgatctcagttcactgcaacttccatctcctgggttcaagcgattctcctgcctcagcctcctgagtagctgggattacaggtgtgagccatggtacctggcccattcggcatattttagtacggagatggtggtcaggcacggtggctcacgcctgtaatcccagcactttgggaggccgaggtgggcggatcacctgaggtcagagttcgagaccagcctggccaacatgatgaaatcccatctctactaaaaatacaaaattagccaggtgtggtggcacacgcctgtaatcccagctactcgggaggctgaggcaggagaattgcttgaaccccagaagtggagtttgcagcaagccaagatcatgccactgcactccagcctgggcaacagagtaagactcaagtctcaattaaagaaaaaaaaaaaaagaaaaaagaaaatattagctgtcacttagcaccctcttcctcattgcctttttctacctgtacaaagagtggccattaaccaggtacccattatgaagaacttgaagcatccttcacgcccactcagagatgttaaaagccagcagaagtcctcgtgtctatttctgccttcatttctaacatcctctgggtattttctgtcccagtggtaaactgctctattgtctttcactaatagggacacatacggctttaatgaattaagagttagattcataggatatttaaaaagaaaagcaattcttgattgttccctacaattatagctgtttaatctttactcataacaactttagtgagacagaattcacatgacatacaattcacccattttaagtgtgcagttaggtggttttgaggacatttacagttgtgcaactgtgaccacagtcagttttagaatatttgcatcatcttcaaagaaaccctgtaccctctagctactactttccatcccccatttccctagctcttggcagccacgaatctattttctgtctctatggatttgcctctttcggatttttttgtatgaatggagtcagacaacatgtggccttctctgtttgacttcttttatggagaaggttcatacctgtaatcccagcactttgggaggccaagactggaggattgcttgagttcaggagtttgagagcatcctgggcaacatagagagaccactatctctacaaaacaaatttaaattagctgggcatggtggtgcatgtctgtggttccagctatactggaggcataattttgttttgtttttgtttgtttgtttgtttttgtttttgtttcgtggggtttttttggttttgttttttgttttttgagatggagttttgctctgtcacccaggctggagtgcaaaggcacgatctcagctcactgcaacgtccgcctcctaggttcaagccattctcctgcctcagcctccgtagcagctgggattacaggcatgcgccaccccgcccagctaatttttgtatttttagtagagacaggttttcaccacgttggccaagctggtctccaactcccgacctcaggtgatccacctgcctcagcctcccaaagcgctgggattaaaggagtgagccactgtggctggccttttatttacatttatttatttatttatttagagacggagtctcactctttcatcaggctggagtgcagtggtgcaatcttggctcactgaaacctccaactctctggttcaagtgactcttctgccttagcttcccaagtagctgggactacaggcactcgccaccatgcccagctaattttttttgtatgtttagtagagatggggtttcaccatgttggccaggatggtctcaatctcctgacctcgtgatccgcccacctcggcctcccgcagtgctgggattacaggcgtgagccactgcggccagcctgtatttacttttgagacaagatattgctctgttgcccaggctggagtgcaggggtacaaacacagatcactgcagtcctgacctcctaggctcaagcgatcctcctgcctcagtctcccgtgtagctgggaccagagacacacaccagcattcctagctaatgttttaaatttttatagagatggagactcgctatgttgcccaggttggtcttgaactcttgggtttaagcaatccttccgtctctacctcccaaagtgctgggattacaggcgtgagccactgcactcagcctcagctattatgaataatgctgctatagacatttgtgtacacgtctttgtgtggacgtatagtatcatttctcttaggtagttacctaggagtggaattgccaggtcatatggcaattcttggtttaatattttgaggaactaccagagtgttttccacagtggctgcactgttttacatccccatcaggaatgcaaaaggataccagtttctctacattttattttttctttgagatggagtctcgctctgtcgcccaggctggagtgcagtgatcttggctcactgcaacctccacctcccaggttcaagtgattctcctgcctcagactcccaagtgtctggaactacatgcgcctgccaccacgcccagctagttgttttttgtatttttagtagagacggggtttctccgtgttggccaggctggtcttgaactcctgacctcaggtgatctgcctatcttggcttcccaaagaactgggattacaagtgtgagccacggtgcccggcccatttctttacattctttgcacttgtaattgtcactctttttggttttagctatcctagtggggataaagtggtatctcactgtggtttgaatttgtatttctctaatgtccaacagccagttaatctttcctttttttctgttttttttttgagacagagtcttgctccatcgcccaggctggagtgcagtggtgtgatctcggctcactgcaagctccgcctcccgggttcatgccattctcctgcctcggcctcccaaatagttgccactacgggtgcccgccaccacgcctggctaatttttttgtattttttagtagagacggagtttcaccgtgttaaccaggatggttttgatctcctgacctcgtgatcagcccatcttggcctcccaaagtgctgggattacagccatgagctggccaccacgcccagccgttgtgtttttttaatcgagacgaggtctcactctgttgcccaagctggagtgcagtggtgtgatcacagctcactgtaacctcctattcctggacccaagtgatcctcctgtctcagcctcccaagtagctggaattacaaccacatgccaccatgcctggatatttaattattattattattttttagagttggggtcttgctatgttgcccaggctgactttaaactcctggcttcaatcgatcctctcactgtggcctcccaaactgctgggattacaggcatgagccactgtgcccagccctagttaacctttgaatgcatattcatgtctgattttggttctgccatagcctggggaggatggcggccaagtgttctttctacctgcagtgtgtgtgtgtgtgtgtgtgtgtgtgtgtgtgtgtgtgtgagagagagagagagagagagagaaatgaaatatagtgtgggactcagggttgagaagcccagggctatggccaaatctaagattaggatgccagccaggcatggtggtttatgcccgtaatcccagcaatttgggaggctgaggcgggtggatcacgaggtcaggagatcaggatcatcctggtcaacatggtgaaatcccgtctctactaaaaatacaaaaattagctgggcgtggtgttggacacttcttgggaggctgaagcaggaaaatcacttgaacccaggaggtggaggttgcagtgagccaagatcacggcactgcacttcagcctgggcaacagaacgagactccacatcaaaacaacaacaacaaaaaccccacaagaatttcatagaaacaatgagtaattttttttagggtaagttatgtcccaaacattacatgggatatacttatcctcaaaaaggtattattgcttatctgaaattcaaattcaactaggcattctgcatttttctttgctaagtctggcaaccctgccagtcactggtgagttgtgtgtccttgagtgatggtctttgcctcttggagcttcagttttctcatctatgggatggggacagaacttgctgggaggcaccaatggcacgcggggttctttgacatctctggatgtggaagctgttgatgtgactgactgggagcctcagactggggttgggtccctgactaggaggggtgggggggctgggactggcatccttgtcctcttgaagctgcctcccagcctgagcttggtccctgcagggttcctgcttggttcagaccccaggcagccagtgttgaggggagggtggagattaatccatagttgtgtactggggctttcctccaacttcctagcaagcaagtgtgtgtgtgtgtgtgtgtgtgtgtgtgtgtgtgtgtgtgtgtgtgtgttttctcgacttagcctaatccatttgctgcatggaatgtgatccaggatcactgctactttttttttcccatttgtttgcttttgctgtgttttgtcgttgttattgttttttctaatttgtgcttcttttgtgggtaattctcagggtggattttttttttttttagaggatttactattcttctttagaacaatctgttttcctcaaagatattggtggaaggtttagtgttttggaacaaaataagcaggggttgtatactgagccttatattctaggtgctgaggactgtggtgtgtgtgttggggaggcggtgtgtgtgtgtgtgtgtgtgtgggtgtgtgggtgtgttggcagagagaagccatctaaagacttcaattttgaaaaacgttaactcaggtgtaagggacacaaggaggagaaacacgcaaataggtgtgccaaggaaaggaaatcagggacggctgcctggaggaggaggcagcatttgaactggatatcttgaagcatgatgggctggatttagaaatagggagctaaggtacaaagcacttcgccagccaaaagatagactagcctagagatgactgttatatgtttgggggaataaacaacagcaagaagaacaacaacaacaaacaacaaaatagctgacattagtgcagcacttactatgtctcaggcactgtttgagtgcttgccctgagttgtttcacttcttcttccatataagccatgttacagaggaggataggagtcttggagttgtgcaagagttgtgggcaggcctgtttagtggtgtgcaggggatgtaggggcagaatcttgagggaagtgcaggatgatggggagccatggtgggcgttggggcctgggagggaccgccttcaggagaatgagaactcagggcatttgggcaatggagatcgggctccctgggaagccctcaccacacccaggtaaaaggtaattaggtcttgattgcaggtcaggagagcagtccgggaaggaaagtcagccagcgaggtgggaggattgacaaaacaaatacatttagctttccttgccccatttctgaccgcgggcacctttatccccgtaaattatctcctgaagatcttctatgttgacgcactggagacagttcccctttctccttctgcacctgccgcgttactcaatcccctgtaatcccattgtcccgactgcatcatttcagaggtggtgattttaaggattttaacagggcttgccaaaagaattattttcttggcgttttgaaagtaattacttaggcatgggtactttacagagaaagctactcatcccggctggctgcagagtttacagggcccgggatgaaaacacagggcccaggtttcctgtccatgaagccggctctgcccctgatccttctgatgcatccaccgtgcgtctgctcacctgtcttgctttctgttcattttctcttgtagtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaaggtacgccggggatacagggttctaagcagtgtctcgtgccttgttctagaaagcttaaaatgttttatggcttaaaaatgttaaatggtcattaggtaggggccggggaatagtgggtggtggcattcactagcccagggagtggcagacattttctgtaaagactcagatagtagatacttcagattttgcaggccatatggtctctgatgcaacgactcaattctgccactgtattggacaagcagccacaggcatgcataaatgtatgactgtggctgtgtttcaataaaactttatttacaaaaacaagtcgtgggccggattttgctcgagggcagcagtttgccaccgcctgtgctagtcagtgaatgttcttcttgcttgggagaggaaaaggagtggaaaactgtagattcggtttttttaaaaaaatagtttagttcttatctgattatagaagtgatattgcttataatagacatttggaaaaagacacttgtaaacgaaaaaaaagcaaaacattcatcttattccacaacgcatgtcgccgagagtagtttattgggggttgttccttctagtgatcttcaggaatctgtcgtgtctactgaaggtttccttaaccattcctgttattgggcattaagatgatttccaggccgggcacggtggctcaggcctgtaatcccagcacttggggaggctgaggcgggtggaccacttgaggtcaggagttcgagaccaacctgaccaacacggtgaaaccccatctctactaaaaatacaaaattagccgggcgtggcggtgcacgcctgtagtcccagctacttgggaggctgaggcaggagaatcacttgaacccgggaggcggaggttgcagtgagccgagattgtgccattgcactccaccctgggcaaccagagggaaactccttctcaaaaaaaaaaaaaaaaaaagataatttctagttttcacaaagagagtgatgaacattttagagtcaaagctttatctagcagttgtttctttaggcttgctttccagaagtgcaatttctgggtcagaggctcttggtgcagattgacaaatggtgttccggaaatgttgtgccaacggccactcctcctagctttggaggagagggaacaccttggccagctttgagtgttatttgaaaaatctttcataatttactgcgggagggaggagctgacgtgttgtcattgtttctatttgcatttctttgattgctatcggggttgaaccttttaaaacatgtttatttatcatttgagttttctcttcctgttcatatcctttgcccatttgtcttttagtacctcagtagcttttgcaaaattaatctgtatgtggttttcatcagtgaaggctactaaccctttgccaattgcattttgttgtttttgttgttcagtggtttaaatgctctgggaagtgttttgctggagaagcttaaaatgtttatggagttcagagctggatttcagtgtgccacttctgtactttacacttagaaagtcttcttctacccatgaaaggttttttttctctacattttatattttaattttttttttttttttgagatggagtttcactcttgttgttaagactggagtgcgatggtgcaatctcggctcactgcaacctctgcctcccgggttcaagcggttctcctgccccagcctcccaagtagctgggattacaggcacccaccaccaagcccagctaatttttgtattgttagtagagacgagatttcactacgttgaccaggctggtctcgaactctcaggtgatccacccacctcggcctcccaaagtgttgggattacaggcgtgagccaccgcgcccagcctatattttaattattattatctaaaaaaattcatcctcactacttgagatctgtttgtgtgtgtgactcaacgggcgtttcgtttctctcccaaatagctaactgggggcctcagacagctgttgattatagaaatctacctctttgccattgctttggggtctgtttctggtgtgtccatagatctgcctctccatgccacagagcggtgactgttctgatcatggtagtgactgttctgatcatggtagttttatcatgttttcatgctcaaggaggcaattccacattcacacattacttgtttgttgtttcatggacttcttttcacatttccctgggaagaactagggaacatgcgatggaggtgggaagaagttaagtgggtggcttgagggttgtatcacaaaagatagaagggaggggagaaaggaggatcttcttatctgagcccaacgctctggggaagccacccagagtgagtgagtccttaaatagacctaaatagaatccttggaattgtctgtgaggactcccttggagcccccagcatgagtccttccatgggacatgttggatggttggaaatcgggagtgggatagttgaaaaaggaagatgggttagtgaagggtggtgggagaggggaccgttattattgcactgtggaaaaatcctgagaatattgtaggtcaggggcaaggagaagctaaactatgaccagagaggttacttaacttgcccagagccacacagctaataaaagacagaactggggtttgtgccaaatttatgcaagacatacaccagaataaaagctatgattttttggaggagtgggaaggatgtcctctctgtttagaaacaagtgagctgcttctagctgggacaccaggggaaacagtgaacattcttttattctattactgagttttccaaatgtagtgcttgtttgaaaagctctaggcctacctatcttgagatataatttaagacattcctctatgaatttatttttgtatctgttttagacaaaatatccagaatggtgttatctgcaattgagtctcctgctccctgctgggtgttcagttgttgttgctgttgtttgtttgtttgtttgtttttgagacagagtctcgttctgtcacccaggctggagtacagtggcacaatctcggctcactgcaacctccacctcctaggttcaagcaattttcctgcctcagcctcccaagtagctgggattacaggtgtcaccacatccggctacttttttttttttttttttgagatggagtttcgcttttgttgcccaggctggagtgcaatggcatgatcttggctcaccgcaatttctgcctcctggcttcaagcgattctcctgcctcagcctcccgagtagctaggattacaggcatgcgccaccacacccagctaattttgtatttttagtagagatgggatttctccatgttggccaggctggtctcgaactcccgacctcaggtgatctgcccgccttggcctcccaaagtgctgggattacaggggtgagccaccgtgcctggccaacacctagctaagttttgtgtatgttgtagagacagggtttggccatgttggtcaggctggtctcaaatttctgagctcaagcacctcggcttcccaaagtgctgggattacatgcatcggccactgtgcctggctgtgcctggctgtgcctgatgttttgagtgaattaaaaattgctttgctattaagaaccaggcttttgtgtccaggaggtcgaagctgcactgagccctgttcatgccactgagctccagcctgggtgacaaactgagactctatctcaaaaacaaaagaaaacaaaaacaaaaatgaacacaaaacaaaacaataaaaagaaccgggcttgtttttccagtactgggggttttgttacccggagaaggtgcgactaacacttcccggggtaccgggttcctggcatgtggtatatatctcagccatccattagtagcagtatccccagggggccaaaaaatgattgttttttgaactgttgcccctgtctttgagagcaactcagcttcagctttctttcccctcttcaatttcttgtattgtgataaaatacacatagaataaatttttcatcttaactttttttttttttgagatggagtcttgctctgccacctaggctggggggcagtggtgtgatctcagctcactgcaacctccgcctcctggattcaaatgattctcctgcctcagccttccgagtgactgggacttataggcaccagccaccatgcccggctaagttttgtattttcaggacagagggggctttgccatgttggccaggatggtctcaaacccctggcctcgagcaatacacccacctcagcctcgcaaagtgctgggattacaggtgagtgccaccgcgcctggccccatcttaaccattttaagtccacagttttcagtggcattaagcacgttcacgtggttttgcaaccatcaccaccaccatctcccaaactttctcatcctcccaaactgaaactctgtccccatgaaacactcactccaccatctccctctcccagccccctggcacctaccatcctattttctgtctctatgaatgtgatgactgtagggacctcctgtgagtggaatcagacgggatttatccttttgtgcctggcttatttcactgagcatgttgtcctcaaggttcatccacgtggtagcctgtgtcggaaattctttcctttttaaggctgaatcatgttccattgtatggagggagcacattttgcctgtgtattcatccatctacgggcacttggtcgctttcacatttctgccattgtgaatcagggccactgctgttgacgcatctagcttttcaatgcctgcattaaccttgttgctgaggctttaggaaacttatttatttatttattttttgagacggagttttgctctcgtcgcccaggctggattgcaatggtgcgatctcagctcactgcaacctctgcctcccgggttcaagcgattctcctgcctcagcctcccgcgtggctcggattacgggcacctgccaccacgcccagttaatgttttggatttttagtagagatggggtttcaccatgttggccaggctggtcttgaactcctgacctcagataatccactggcctcggcctcccaaagtgctgggattacaggcgtgagctaccgcgcccagccttaggaggcttatttgatgtctgatgggatttttgaatacagaatagattgagccttcagaggatactcccctgtcttaggtgacagaaatgggctggagaaaactatccatcaacccctcttttcccccagagtcttttcagatacttctgtgaacatccgtagttgctatttttgtcttccacacttggcagcttctggaagcatcaggggaatgcatcaacatttaggatgaaggtgctggtttgtcctttggacctagtttaagcaattccgagcaacatccaccccttcttctacctgtcccttaagcactttttacagggagaccaaaaaaaggctttcaatggttaagggggccgggtgtggaggccccacacctgtaatcccagcactttgggaggccgaggtaggtggatcgcttgaggtcaggagttcgagaccagcctggctaacatagcaaaacgctgtctctactaaaaatatgaaaattagccaggcgtggtggtgggcgcctgtaatcccagctacttaggaggctgaggcaggagaatcactcgaacccgagaggcagaggttgcagtgagctgagatcgtgccattgcaccccagcctggccgacagagtgaaactccattttttaaaaaaagaaaaaaaaatggttaggggaattaaaagaaaaacaaaaaaacatggcatgtgctaatgatccatagcctggacaccctctctccattatcctgcaatggatttggggcaaagataccaggagaggtccaatgcacgaagccttacatgggaagagtggagacggggtctatgcagttcgtttattgactgcctactaggtgtcatgttctggggcgctcagggcataggaagggagccagcctttgcctcctcagagcggccagtctagtggcaaatgcagatgttcacgatcaaaccaagtacactcagaagagggggagagttagagggagatctacattagttcagccagctggacgcggtggctcatgcttgtaatgccagcactttgggaggccgaggagggcagactgcttgagctcaggagttcgagaccagcctgggcaacatggagaaaccccgtctcgacaaaaaatacaaaaattagccaggcatggtggcaggtgcctgtaaccccagctacttggaaggctgaggtgggaggatcgcatgggccccgggggcggaggtcgcagtgagctgagatcacaccactgcactccagcctgggcgacagagtgagactcggtgagactctgtctttaaaaaaaaaaaaaagaagttctttgaggcaagcagcaccggcttccagtctcgttttaccattgactggtcacaagctggttcaagcctcagtttctccatctgaaaaatgggggtcattatgggacctgcttcttagggtggtggtgtgggggttgaatgagatggtgcagggggaggcacttaacctagcctcaggtgctccgtgagtgtcctggaagcttccagtaagtaagcaccatgggcccaccctatctgggcagactagcttccaggtgaatatctaccagggctcagcctcatttctgactttggttttgaggcaggcagaggaacatgtatcttgcgacctgctgatgagggatgggtgccacacctccagccccagagggaagaccaccctgatttttgggtgccaacagcatgggatgctctggaaattctcagctctgggcattttgaggggaccagaagccacagggcttgcctgaccagctgctttagccaaacccactggcattttctttctgggaggtcaccccagctgctcactgccggccagaggggtgggtgaggccgggacatgctgggtgccaggggaaaccaacccgagatgccacatatggacgtcggcaccaaagcaggagggggaggctgaaagcagcaaatccctcctccctgggtctgagattacagctccgagtcaaagtctctcaaagtgtggtattgtgcctaccacattaaatatcacgtatttaaatgcacgagtttaaatgcatgctcttggagggtttgatttttggcagaatttttagctgcctatggaaactctctgcttctttttcttcttccatttaaaaagtttgccttgatattttatttttttacatttttatttagtttttaatatttttttaaattgagatgggagtcttgctatgtggctcaggtcggtctcaaactcctggactctaaggaatccccccacctcagcctctcaaagtgctgagatttcacatgtgagccaccacgctggacttgacttgattttgttttctttttcttttttttttttttgagacagagtctcgctctgttgtccaggctggagtgcagtggcatgatctgagctcactgcaacctccgcctcctgggttcaagcgattcttctgcctcaacctcctgagtagctgggattacaggcacgtgccaccatgcctggctaatgtttgtatttttagtagagatggggtttcgccatgttgcctaggctggtcttgaactcctggcctcaagtgatccgcctgccttggcctaccaaagtgctgggattacaggtgtgaaccactactctgggcttgccttggtattttaacaatcggaattgtctttgtggcaaatgctgatttcatgccagccgtggttctgggtgctttgattaggatattgcatcccatcttcccaacaatcttatttattgttgagaccactaaggcttcgagaggttaagcaacttctacttccaacactgccccgcccaccccttccgccgcgcaccccacacacatgggtagtaagtagtggagatgggatttgaagctggggattctggctcagaatccaagctctttacctttgtgtcttatagatgtcattgcgggaagttggtgaaatgcaggaaactgtaaaaagaaaggaaggaaggagggaaggaaggaaggagggaagaaagaaaagaaaaggaaggaaaaaaggaaggagggaagaaataaaaggaaagaaaggaaggaaggaaggagggaaggcgggaaggaaagaaggagggaaggagaaaggaaggaagaaagaaaggaaggaaggagggaaggaaaggagggaaggagaaatgaaagaaggagtgaaggaaggaaggaggaaagaaaaaaaggaaggagggaaggaaggaaggaagaaggaaaggaaggagggaaggaaggaaggaaagaaggaaaagaaactggagaggaaatctagaatttgcccctgccaacatgtgtgttgcctcttcttatcagccttctcattctgtcttgacttagggcctctcctatcagactaagctctcctgaaggcagggactttgttgtatctcaagcacctgtcatagtacctggctcacagttgacaatgacatccttaacactcatcaatagctagtgtttactgagcacttactatgtgctaagcaatgccttaggggatcccatcacagcctatgagggtttgttatcctcattttacagaagagggaactgaggcatggctaggaattatgagacttgctctaggagacctagctggggaatggtttgacttcagacttgtctgacgtaaggcctttgcccagtgatcagcaaactacgacctgtgggccaaatccagtccgccagctgctatttttgtatgacctatgagctaagaattttttattttatttttatttttagagatggggtctcactctgtcgcctgggctggagtgcagtggggtgatcataggccactgccacctcagtcagcctcctcagtagctggaaccacaggcaggcaccaccacgcccagctaatttctttttatttttttagtagagatggggtcttgctatgttgcccaggctggtctcaaacaattgggttcaagcaatcctcctttcttggcctcccaaagtgctgggactataggcgtgagccactgtgcttgcctggcttaagaatgctttttcacatttttggccgggcatggtggctcatgcctgtaatcccagcaccttgggaggccgaagcgggcagatcactcgaggccaggagttcaagaccaccctggccaacatggagaaaccccatctctactaaaaaatgtacaaacattagctgagcgtggtggcgggcacctgtaatcccagctactcaggaggctgaggcaggagaatcacttgaacctgggaggcggaagttgcaatgagtggagattgcgccactgcactccagcctgggtgacagggtgagactctgtctatatatgagctggacattcagcattcagggatagaggctgtttcagtgggacttgggagcaccacggcctgaggccatacagcccagctgccctttgctggtacttccttccttccttccctctttccttcctttctttccttttctttcttccctccttcctttcttccttccttccttactttttgagactctgtctcaaaaaagaaaaaaagaaaaaaaaatgtggggtagagcactgtactgaaaaaaattccacagtagttgtaattcatttttcactcagatgattagcattttttttttttttttttggagctctctgtttgggtggaggagggcagtatatgtacaaggcaaggcccccactccaccctcctccctcctcccaccccgcctttccccttcgagtgagtcatcgaacccgtgcttctagacgtgtttggagcagagcacctggaaatcatgatgttctctagataacagggaatattgataaattcccttgtggcgatgtcactgtcgtccatacagaagacaggaaagtgtaacgcctgcacacggggatccaacaaaaagaaaaagataaggtgggggaggccgggcacggtggctcaggcctgtaatcccagcactttgggaagccaaggtgggtggatcaactgaggtcaggagttcgagaccaccctgggccaacatagtgaaaccccgtctctactaaaaatacaaaaattagctgggtatggtggtgggcacctgtaatcccagctgcttgggagactgagacaggagaatcgcttgaacccaggaggcggaggttgcagtgagccgagattgtgccactgcactccagcctgggtgtcacagcgagactccatctcaaaaaaagaaaaaaaaaaaaaaaaaaaaaggtagggtagagcatgtaacgtgaatgatggcccacttgaatctctcattcgtctttcttcccttttatgttgtcaaagatctttaaaaaaaaaatctaggagagaaacaaacaaaaaaaactgtactgaaaaaaattccacagtagttgtaattcatttttcactcagatgattggcatttttttttcttgttttttctttttgagacaagggtctcaactctgttgtccaggctggggtgcagtggcgcaatcttggcttacttccgcctcctgagtagctggaattccaggcacgcaccaccatgctggctaatttttgtattttttgtagacatggggtttcaccacgttacccaggctggtcttgaactgctgggcccaagcaatccacctgcttcaacctcccaaactgttgcattatattataggtgtgagccactgtgccagccaggattggaattatttatttatttatttagtgagatggagtcttgctctgttgcccaggctgaagtgcagtggcgcaatctcggctcactgcaacccctgcctcccgggttcaagtgattctcctgcctcagcctcccaagtagctgggactacaggcgcccaccaccacacccggctaattgttgtgttttttttgtatttttagtagagacagggtttcactatgttggccagggtggtctcgaactcctgacctcaggtgatcctcccactttggcctcccaaagcgctgggattacaggcgtgagccgccatgcccagcccttatttattcatttttattttattttaaaataaaataaattttaaaaatttgattgaaattttttaaacaaacttttcactttggagatgattggattttgtagagcaggaaagaacaagtaccctagagagtatgtttctgggctcccggctcctcttccgggggttgaagatgaattgccgttggcctttgtaaaagaggagagattgttccagattggagtggcagagatgtgctttggtttgggtggcaaggatcacaaagaaagaagatgaggttgggtgtggtgggtcatacctgtaaacccagcactttgggaggccgaggcaggaggatcacttgaacctagaattcgagctcagcctgggcaacatagcaagaccccatctctacaaaaaattttaaaaaattagccaagcatggtgctgtgtgcctatagtcccagctactcaggagtctgaggtgggaggatcgcttgagcctgggactttgaggctgcaatgagctatgattacaccactgtaccccagcctgggtaacagagtgagaccctgtctcaaaaacaaacaaacaaaaacagaaggaaggaaggaaggaaagaaagaaagaaagaaagagaaaagacaagacaagaaaaaaaaaaaaaaagaaaagacagggtgagagggaagggtattcgggtggatgaaatggcaaagagaaggccaagaggcgttttgtgggcaagagtgaagagggtgcctcatgccgggaagggaggcttggaccagtgcagggtccttatgggctccaatgccgtcatgaaggtcacacaggggctgtgtttaggaggggctgtttccaccaatactgagtggacagccttgctgagccaggctttttgttgcgtccccgaagtccttgctgagtcagggaggaagtcaaagtaactatcaggttagataagctgatgggtgggcagaaagtgttttggtgggttcaaggctgcgctgaaagatggtagaccagttgaccgtgtggtcacttggctgccccagagatgatgctgtctaaatcttgagtggtgaagataacgaatttacaattcccaccattgcctggcttcctggagcgggtgggtgcggggaccggggaggggggccgggggaggctgagggctatcagttgaaactgaccttttggcccaatccttttgggaagaaggcgggtagagttaaaatccatcgtaatggaaaggcggctttccctttggctgtctgctaacttggtgactggcctgacaagtttttcttttccttcctcctacctgatactcactgaccggttacttcccatgtcacccgaccctttgtcagaattaaaatctgttctttgtgactgaacacctgaaatgccccggggaggacccaaggaagtcagcgagcgcctgtgcgtcaggctggcagcccaggtccttcagtgatctgtttctctcaatgcgcctgtgtcagatagaaccgtgcatttcccagtaaaaggaggtgatgtgtgtgctggagtttcaagattgtaccccttatcctatctcccctttcctctgtcttccctctctacttttttattttgttgtttgtttgtttgtttttgagatggggtcttgctctgtcacccaggctgcagtgcagtggtgcgatcatagctcactgcagcctcagccttttgggctcaagcaatcctccagcctcagcctggccagtagctggaactatgggtgcatgccaccacgcccagctaattttatttacttatttacttatttattaaagagatggagtcttgctatgtttcccaggcagctcacaaattcctgtcctcaagtgaccctctcgcttcagcctcccccattagctaagactacaggtgcgcaccaccatccctggctaatttattttttaaatttttctttttgtagagatggggattttgctatgttgcccaggctggtcttgaactcttagactcaagcaatcctcccactttgggaagcccaaagtgttaggattacaggtgtcagccaccaggccgacctgtttgctcatttttccttttccttttttcttttcttttcttttttctttttttttttgagatggagtttcgctctgtcacccaggctggagcacagtgacacaatctcggctcactgcaacctctgcctcccaggttcaagcgattctcctacctcagcctcctgagtgctgggattacaggggcatgccaccacgcccggctgatttttgtattttttagtgaagacggggtttcaccaggttggccaggctagtctcaaactcctggcctcaaatgatccaccagcctcagcctcccaaagtgttgggatgacaggcgtgagccaccacactcggcccgtttgctcatttttaaacataaatgatgtcaagagtgggaagcaaacaagaaagtgttgaaagcattgctctcctctgctccctggttacctatcatcctggggcccgaggagtggctgcagattgggccaccttcctccaatcacaggtttgggaagtggaccaaagtctttcaacacactggacttagcatgatcatcaaatttgcactggaggggccaggcacacgcctgtaatcccagcactcggggaggctgaggcgggcagatcacttgaggtcaggagttcgagaccagcctggccaacgtggtgaaaccccgtctctactaaaaatacaaaaataagccgggctggtggttggaacctgtaatcccagctactcggggggctgaggcaggaggattgcttgaacccgggaggtggaggttgcagtgagtcgagatcacgtcactgcactccagcctgggtgacaaaagcaaaacctcgtatcaaataattaaataaataaataaacaaataaataaataaaaaattacactgtagggcatgtggtaggtgaagcccaccattgtcaagtacctacctagagggtttggggtagagggtcctgtggcttcttctattttttttttttggcggagtctcactctgtcaccaggctggagtgctgtggcacgatcttggctcgctgcaacctccgcctcccgggttcaagggattcccccgcctcagcctcctgagtagctgggactacaggcgcccgccaccacgcccggctaatttttttgtattttagtagagacagggtttcaccatgttggccaggatggtctcaatctcttgaccttgtgatctgcccgccttggcctcccagggtgctgggattacaggcgtgagccaccgcgcctggctgtggcttctttatcctagaagtttctttgcctctcgttttgtcccaggcgaggagggtcttggatctttaatgactccatggcttattgagtgtagcccagaaagaatggttgtttaataggctttattaccgagtgtttccaagggcttacctggggaaggaaaacatttttactcggaggtctgataaggatgggctttaaagcgctggcagctagtcatgtccacacgcggtgtgcgaagcacggcgttgtttactgaccacctgcaaagcccgtcggctggtgaacaaggctcttgtcccaggctgcctcattggtggtgatgatgttaagagtttcctcatttgcaaataaattgactaacctagcagacgggtttgatccaaagtggtcaagattccttttctttaaatttgttttttttttgagatggagtcttgctctgtcacccaggctggagtgcagtggcgtgatctcagctcactgcaacctcctggattcaagcgattctcctgcctcagcctcctgagtaactgggattataggtgaacaccaccacgcctggctactttttttgtatttttagtagagatggggtttcgtcatgttggccagaatggtcttgaactcctgacctcaagtgatccacccacctcgacctcccaaagtgctgggattacaggcgtgcgccactacgcactggcaaatttttgtattttcagtagagacagggtttcgccatgttggccaggctggtcttgaactccggacctcaggtgatccacccacctcagccacccaaagtgctacaattacaggcgtgagccaccgcacctgggctattttcacttctttcgaagttatacctaggagtggaatcgctgggtcagttggtaattctatatttaattaatggaatcaagatttctttttcttttctttttttggttttactttaaaaaattctatcttattacataaaaaaaccacaggttcagaaaagccacaccaaacaaatgaatagcctaatggttcactctaacgtcaacactcatataatccctaactctggttgagaaatagtactttgccagaacaccccctccaaaagccatgccacggaccacatcctagtcacaggcctcttcccccagagtagtcactgtcctgtcttttgtagacatcacttccttctttctgtatagttttatcacccaagtgtgaatctgtagacaaatatttagctttgcccattaaaaaaaaaaattgatggccgggcatggtggctcatgcctgtaatctcagcactttgggaggctgaggcgggaggatcacttgaagccaagagttggagaccagcctggacaacatagtgagaccccatctctactaaaaataaaataaaaaattagccgagcatggtggtgcatgcctgtagtcccagctactcgggaggctgaggtgggaggatcgcttgagcacagaaggttgaggctgtaatgagccgagattgcatattgcactccagcctgcgtgacagagcaagaccctggctcaaaaattaacacaataaaataaattgatgtgtttgtttgggtctctagcagtggttttgaactgagggtgattttttttgtctcccaggggacatttggcaatgtctggagatattttttggttgtcacaactccagggaatgtgtgtgtactgctttcattgagcagatggaggccagggatgccgttcaacgtcctgcaatgcagagacagcccagccacaaagaatgatccagccccaaatgtcaatagtgctgaggggcagaaagcctggtccacaggttctccctccatccctttccttttaccttctctctgttgaagagctgggctttctggcttggggtgcagtccccagtctgagtgttgctgatcgtacgttcctgggacagttctgcttgcccctctgagctccagactcagagctagggtcacactcaggttctacctcttggactgactttatttaacaagtaccatttcagcactctctgcagtcagctgttttcaaaggcgaccatgcttgatgctgttcgtttgcacatggctctgagtggtggtgtgttctttgattttttttctttttcttttgttttaaagaaaaacacaccgttttttaaacacggttgcccgaactctcatcttcttcctccctgccctccctccctccctcctctccttccttccttccctccctccttccttcctttttctttatttcctcccttccttccttctctccctccctctcccttcctccctttatccttctctctttccttccttccttctctttcttttctttctttcttttcttccttttctttcttctttcttttcttctttcttccttgctttctttttatttcttacctcccttccttctctcccttcctctctccctcctccttcctctttccctttctccctcctctttctttttctctctcttcctttcatttttctcccctcccctccccttcttctcctcccctccttcccctctcctccttcccatcccctctcttcccttttcttcctttccttcttttccctccctctctctttcttttctcctttcctttcctttccctctcttttctttctttcttttctttcgacagggtcttgctctgtcacccaggctggagtgcagtagcatgatcatagctaacagcagtctggaactcctggtctcaagccatcctcccacctcagcctccagagtagttgggactacaggcccctgtcaccatgcccagttattttattttatttttttttgagacagagtctggctctgttgcccaggttggagtgcagtggtgcgatctcagctgtctgtaacctccacctcttgggctcaagtgattctcctgcctcagcctcctgagtagctgggactacaggcacctgccaccacgcccggctaattttttgtatttttagtagagacggggtttcaccctgttagccaggatggtctcgatctcctgacctcgtgatccaccctccttggcctcccaaagtgctgggattacaggcgtgagccaccgcgcccagccgctaatttttttttaatttattttttgtacagatggagtctcactatattgcccaggctggtcttgaactccagggctcaagcagttctggcacactagcctcccccaattcaatgggattacaggtgtacccattttttaaaaatgggccagactaaatatttgtctagagatccatacttgagtgataaagctatatgaggttccatctgggaattcggttctgcggtaaaacggtgccgacgggcctccctttttttagtgtctgacaaacagggcacagaccgaacttcataacaaaactttgtgttcttgacgaaggcaagttttgctaagaaaattatttttataagcgagaaaggtatgaaggttatttgcaaaggaattttactggggtgagaaaaaaagcaagaggtttaccttaggattcctggtggtaaagaagatggaatgggcagaagacgtcatcacagatgtcacggggagagcgatagctgaacctctgaaaggaaagaggttcccagggaaggatgaatttgatgcaggaaaaaagttagaggatggtcttaaatttgtcaatgtagttcagaggaaagtgtaattcttcacagacttttagttttgaaaggatggcttcaaaagatactgggggacatgggcgcagtaactcacgcctgtaatcccagcattttgggaggccgaggtgggcggatcatctgaggtggggagttcgagaccagcctgatcaacatggagaaaccctgtctctactaaaaatacttaattagctgggcgtggtggcgcatgcctgtagtcccagctacgtgggaggctgaggcaggagaccatcgcttgaacctgggaggcagagtttgcagtgagccaagatcacgccactgcactccagcctgggcaacagagtgagactccgtctcaaaaaaaaaaaaaaaaaaaaattctggccaaccgggaatagtccaggataatccattcttcagaacttgttcttgctaactcagttaagtgtcgaatggcgtgggttgtctactgtattttagaggacattagaatatttatgaagggctttcccaggtttactcataacttcattttcctcatgctatttgtcccttaaagtctttctgaaatctttcagttgccacttcttctgggtgggtgggtatgtatgttgagggtcatgctttttttttttttttttttttttgagatggggtctccctctgtcgcccaggctggagtgcagtgatgtaatcacacctcactgaagcctcaacctctcaggcttaagtgatcctcccacctcagcctcccaagtagctggcactacaggcatgaaccaccgtgcctgactaatttttaaaaaatatttttgcaaaattagccaggcgcggtggtgcacgcctgtagtcccagctacctgggggactgaggtgggaggattgcttgagcctgggaggttgaggctgcagtgagccaagatcatgccactgcactccagcctgggtgacagagcgagaccctgtctccaaaaataaaaaaataaaaaataaaaaataaaagatggagtcttgctgtgttgcccaggttggtcttgaactcctgggctcaagtgatcctcctgccttggcttcccaaagttctggaattataggcatgagccactgcacctgtctgggtcctgcttttggtagtgatatagaaccaacttagtgaaattctagaatgacgctgtccactaaggtagctctgccagccacagccacatgtggcaatttaagtagaaattcattaaaattagatatttgtccctcagttgtactcaccatatttagacaatgcagacagacaatgttgctatcactgcaaaaacttgtattgggtacctctgccttagaacttttcattccatgatgaaagattgttctggagtcagacaggcctgcatttgaagcctatatctgttttgtgaccttgggcaaattgtctagcttttctgaatgtctgttttttcttctatcatgaggacatgataagggaaccagtctccaaggttttcctcagctttgaactggtatatcccctctttcgataaaaataaaaatccagttcctcttccctacttggagtttgttcttttttcctctaaatataaaatataccgttgaatgttttttcaacctctccaccccttgagagtccctggaatagagaggaaggagtggcttgggaaagttgatcacaacaaagaggctattataggtacatctaatcgagaagaggaacaaggaaggagtaggtgtgttgaccggggctcagagtgtcttgtctgtgggtcaccaagaatgaggaatgtgtcagctccttcctggcttctcctctctgggaacagagaacagtgcattgcagcttaagtggagtaaaatgggtgtgggtttggaggaagtggattaaggatggggaaggggccgtgggagagaaccccagcctgagtttgtcttcctggctcagcactgagtgtctcagtcaacacatgaatgccagtaatgggaatctatttggattcacttaagccatgaggtgggggcagtgtgttaactggggcaacacagggctctcagcttgaatcagctagcttttgctgtgtagcaaaccactctgaaacacagaccttggaatttatattcaagtttaatcatggagcttgtatcagctagcttttcctgtgtagcaaaccactctgaaacatagaactaggaacttgtatccaagttcattcatggagcttgtatcagctagcttttgctgtgtaacaaaccaccctgaaacatacaacttggaacttgttgtatccaagttcagtcatggagtttgtatcagctaatttttgctgtgtaacaaaccaccctgaaacatagaacttagaacttgttgtatccaagttcaatcatggagcttgtatcagctagttttgctgtgtaacaaaccaccctgaaacataaaactgggaacttgttgtatccacgttcaatcatggaacttttatcagctaacttttgctgtgtaacaaactactctgaaacgtaatggcttaatcaacaatcatgtacttagctcatgattctttgggtcgctgggcaagttttcttgtttagacccaccagctgaccacaaacacaggctcttttctctctcatgtctgggatcaaccagtgggttgtctggtagctggatggtctagcatggcctcactcacatgtctggtggttggtgctggctgtcagctgggaggccttggttttcttccctgtagctgctcatcctccagttggctagtttgggcttagattacatgatagtctcagcgttccaagagtggcaagagatcaatttccagtacaaaagtgccttttgagtttctgtttgcatcttgtgtgctaacatcccattggctaaggtgagctgggagggaaagggagaatatagtctttacctgttgatggaagaggaagaatttgtggccctgtttgccatctgccaaagaaccctggagtgggaaacagtggggctcataaaacatttttttaaaaacctcttattttaggttcatgagtacaataacattttaatcagaatttggagctcaattggacatcaggactgtgtatggtgtgactgaggacattaaatgatttttttttgagtaggaatttaactttatgaattccacttgttgaataaccaattccttccccagtaattcttgatgttttcttcatcaggtattaaattcaaccaaaaccatgaatttgcttttgggatatcaattctatttcaagtcctctgtgtcttaatcttatcccagtaccatactgtttatagatttagaatatgtgtttttttagttttgtttttgttgtcgttttgtttttaaagaagtggggctcggctgggcgtggtggctcatgcctgcaatcccagcattttgggaggccgaggtggctggatcacttgaagtcaggagttcgagaccagcctggccaacacagtgaaaccccgctactataaatacaaaaattagccgggcatggtggcacatgcctgtagtcccagctacttgggaacctgagacaggagagttgcttgaacttgggaggtggaggttcaatgagccgagattgtgccactgcacttgagtctgggtgacagagcgagattctgtcttcaaaaaaagaatgggggctcactgtgttgcctaggctggactcaaactcctgggtgcaagtgatcctccttagcctccaagttgctgggactacaagctcatgcctggtaagaacatgctttataaagtggcaaatctagttttttccctattacaccttttagaagagtgtttccttttctggttgaactaaatatttccctcctctcactctcatataaaacccattgagggctgggcgcggtggctcacgcctgtaatcccagcacttggggaggccgaggcaggtggatcacgaggtcaggagatcgagaccatcctggctaacacggtaaaaccctgtctctactaaaaatacaaaaaaattagccgggcatggtggtgggcacctgtagtcccagctactcgggaggctgaggcaggagaatggcgtgaacttgggaggcggagcttgcagtgagccgagatcatgccactgcactccagcctgggcgacagagcgagactccatcttgaaaaaaaaaaaaaaaaaaaaagcaaaaacaaaaacaaaaaaacccattgagatattgatttaaaaatttaattaaaaacataacccatttcccagaggaaaaaaagtgcagctcgctgccagcactcctttaattttacataaacatgttctttgaggctgaagcaaatctgactgattttcaatatgagaaaatataaaacggttcttggagttatttctaaacagaacttgtctctaatcttaatgtaacagaaatgtctataatgttacattaggattagagaatagattattcttgggacaaatggaaaaatgggttaaaatccataaattaagaaatcaatactttcgtatttttcctttccgggcaggtatgggatctccttttccatttgctcaaatctttttttttctttttgagacagagtctcgccctgtcacccaggctggagagtagtggcacgatctcggctcactgcaacctctgcctcccaagttcaaacaattcttgtgcctcagcctcctgagtagctgggattataggcacacaccaccatgcccggctaatttttgtatttttagtagagacggggtttcaccatgttggccaggctggtctcgaattcctggcctcaagtcatctgcccacttcggcctcccaaagtgctgggatgacaggcatgagccactgcgcccagccaatttgttcaaatcttttatattgtcctttcttcatctttatcctgtattatttttgtgacgatggttcctgatttctgtatcacagagttttgttgtgttagttatggctactatgaatagcatatttaccctgaatccagatactttagtgaaattgattggtaggtttttaaattgttttattcattgtgtgcaatttcgtcctctacaaattatggtcatttaaaaaaattatgtctgctcagttctggaagcatgaaaaaaattatgtctaaaatcatacctcttgtttcggttttaaatcttattctattgaccagggcttctagactaacattaaatatttaacaatggtattatccgacatctatgtttaatagatttcctaatataaaatcatccttgctttcctgtggtaaaacctacttggttgtgatgaattattctttcagcataacgttgaattcgatttgctaggtttgctttgtttcgttttctgaattcttgccatctgtgttcatgagtgaaattgggctatgtttttggttggttttattttgcaatgtcttcatcagtttggattatttattgtgttctagccacataaaatgaaatagcaggtaactgagtattcattgacaaattttatggtgccataacttttggggggaagcaattctttgataacttaagaaaaaatttaggccaggtgcggtggctcatgcctgtaatcccagcactttgggaggctgaggcaggtagatcactggaggtcaggggttcgagaccagcctggccaacatggtgaaaccccgtctctactaaaaatacaaaaattagccaggtgtggtggcgcacgcctgtaatcccagctactcgggaagctgaggcaggagaatcacttgaacccaggaagcggaggttgcagtgagccgagatcgcaccactgcactccagcctgggcagtagagctagactgcatctcaaaaaaaaaaaaaaaaaaaaaaaaaaaaaccaaaacagtgtgtgactggctgtgacgtaaggcagtcagacctctccttcgaaatgggccgtgattcatctttatttttgtagggctgtgtcacgttagaaccactacagcaaaagttttcattggaaatctaataatgtttttttagtctgccatctggagtctgtgctccttgtatgtctttattgttcaagactaagagtggtgtgtgtgtctgtgttggggggatggggtttggtaattttgctaacatggctctaagaatctgtcccgcttcccaaaacctcatttttctctgctttagcagtagcccaacactgaaaacagggtactgcttttttagaggagttctgatttggattccttttctttctttttttttaggccaaaattttcatttataaatagcttctgtggtacacaacatgcaaatatttttggtttcatgatattacaccagagttgcagagttgtagctgttttttttttttttttttttgaggcagtctcgctgtgtcacccaggctggagagcagtggtgcgatcttggctcactgtaacctccacctcccgggttcaagcaattctcttgtctcagcctcctgagtagctgggattacaggcgcccacaccacacctggctaatttttgtgtttttagtagagacggggtttcaccatgttggccaggctggtctcgaactcctgacctcaagtgatctgccctcctcctcagcctttcaaatgctgggaatacaggcatgagccaccacacccggctgaacttttattattttaaaaacatttttatttatagtaaaagtcacacataaaatgaaatttgctgtttttagaaagaatgtttaaaaagatgtgtaccatgttgcccagtacagtggctattcagaaacagccatagtacaccacagcctcaaactcctgggctaaagggatcctcaagcttcagcctcccaagtagctggggctacaggaacacaccaccacatctggcttgcctccttctccttctctttctccttttccttctccttctcctcctccttcttctttttttttttttgagacaagagtctcactctgtcacccaggctagagtgcagtggcatgatcttggctcactgcaatttctgcctcctgagttcaaagcaattctcctgcctcagcctcctaagcagctgggattacaggtgcataccaccatacctggctaatttttgtacttttagtagagacggggtttcaccatgttggccagtcccgaactcctgacgtccagtgatcctcctactgcggccttccagagtgcacaggcatgagccactgtgcctggcttgttttcttctttttttaaatttaatgagtttaggcagggtttctcagcctcaacagtgttagcattctgggctgaacccctctccgtggtggggactgccctgtacattacaggaagcttagtagcatccctggcctccactcaataccagtagcaaccccaagtcatgacaaccaaaaatgtctccggatactgccaagtgctgggatcacaggcatgtgccaccatgcccagctgatttatttttattttattatttttgagacagtctcgctctgtcgcccaggctggagtgcactggcacgatctcagctcactgcaacctctgcctcccgggttcaagtgattctcctgcctcagcctcccaagtagctgggattataggtgcacgccactatgcctggcaaagttttgtatttttgtagagacggggtttcaccatgttggcaggctggtctcgaactcctgacctccagtgatccacccgcctgggcaatatagcaagaccccatctctaccaaaaatttaaaaaaatttagccgggggtggcggcatgttcttgtagttctggctactcacgaggctaaagtgggaggatcatttgagcccaggagttggaggctgcagtgagctacgatcacaccactgcactccagcctggacaacagggcaaggcctcatctcttaaaaaaaaaaaaaaaaacaaaataaaataaaaagtgaataagtgaaagtaataaaatgtaagatacagttggagttctctttgtcatcttcccttgctatattctcctcccttcttcccagaggtaacaactctcttaggtttggtacataaacttccagccctgcatgtattttgacacataaccttgtacacacgtcaatgccagatacaggttcagtatcccttattcaaaatgcttgggaccagaagtgtttcccacttgggattttagaatatgtgcgtatatgtaatgagatactgtggggctgagaacgaggtctaaacgttaaattcatttatgtttcatgtacatcttatacacatagcctggaggtaattgtatacaatattttcagtaatattgtgcgggaaacaaggttttcaccgccctgactgtgacctgtcacaagaggtcaggaatggaattttcttccactgctatcatgtcggcgctcaaaaagttgaattttggagcatttaggattttggattttcgggccaggaaattttggagcatttaagattttggattttgggttatcttcagttgttctttaaatctatttatttatttatttgtatttgacaacgagtttcactcttgtcaccctggctggagtgcaatggcgcaatcttggcttactgcaacctccgccttgcctcaagcaattctgctctctagtggctcagattacaggtgtgcaccaccacgcctggctaatttatgtatttttgtagagatggggtttcaccatgttggcctggctggtctcaaactcccgacttcaggtaatccacctgcctcagcctcccaaagtgctgggattacaggcatgagccaccacgcctggcataaatctttctttaaatctttcgctgctgtaataaaatatacatcataaaatttgccatcttatttatttttcagtatacagttcactggtgttaaacactgccatttatattgtaatacacttttgagtattctaaatatctgcatatattgggaagctaagtagtactatcccttaggaagccattgtgtattttgcacgtaaagcacatttcagttctgactggccacacgtggctggtcctgctgtaatggatctagtctttaaaaatactccgcgagagcttgcagtgagctgagatggcgccactgcactccagcctgggcgacagagtgagactccgtctcaaaaaaaaccaaaaaacaaaaaactctgcgatcttcctcaccatgcacacatatgatatttttgtgattgtgattccaattgctacacctgctgcatgagttcttaagccaaatgcttttttttttcctctcagccactatgttctttaagtttatgcctcttgattcagtattgctagttcattcttttaagtgctacatagtatcttgtatgaataagccacatgctactcaccagctcccctagtgggaggcattgagattgtttccggtttgtttcttttataaacaatgctgcaatgaacatcttggtgtccatctcctcctacccatttgtgaatggttttctaggattgatgttcagaattgaagtcacagggaatggagtatgtgcatttttagatctagtatatactccccgaatggtctccaaggtggctgtgacagtttcaccagtgatgcattaaggtatatgtcaaatgtgggcaaggctgcaggaaaattatgttaattccagtgcatggaaattggtatcctatggtattcttttgcatctccctgattcctggtaagactgggaatctctctgtatgcttcttagccatgtcttcctacctcttcctcctctttccctgggagctgttttggggtgggggggctgggcctttttcttcagggactctgcattggcaacgtcacaaagaggtgcacaagggattgaagtgtcggaaatgctttgctgctgtcattgcatttctttacccagcatttcaattgtgctttgctttgcttttctcacttgaaattgtggccagatagaaacccagttagactaataagcatccatctttttaaatctctttgagatgctgatgtttggatatcttcagttgctcttctttaaatctgtaattttttttttgtagtaataataggacatgcatcataaaattgaccatcttaaccttttttttttttttttttttttttgagaattcatctgttgatggacatttgggttgtttccgccttctggccattgtaactaacgctgggaaaaacacgggtctacaaatatctgtttgtggctgcccaagttttggggacacatagtggaagcccaccccttcctgattgaagcatggggcccattgagagacttagcccataggagcctctttccagtgaggaatatggagggaatggagggcagtacaaaagttctccggcctggacccttgtgattctttgaaggctgagacgagagatgagactcatggctgggttcactttttggttcactttccctttccttttttttttttttttttttttgagatggagcactctgttgcccaggctggagtgcaatggcgtgatctcagctcattgcaacctctacctcctgggttcaagtgattctcctgcctcagcctctcgggtagctggaattacaggtgcatgccaccacgcccggctaatttttgtattttttagtagagatggggtttcaccatgttggccaggctggtcttgaactcatgacctcaagtgatctacgcacctcagcctctcaaagtactgggattacaggcgtgagccactgagcctggcctctttttccattttctgttgcatcaatggaaagtccatctcctgcccgtggacgttttctatgttgatgtggaatgtggcatttgtccaggaacttggtgctttttttttccctctattatttcatttgcttttggattttgagagatggagaacttccttagtgtgggagggaaacagttatggatttactttatgattctacattcaatcctggtctcttcaaatgatttcagggcttgtttggccaggtcaagtctgttctaggaggattttctttccatccttcctctgggaaatgaatgagtataaaaacatgcccaagatggagggaaacctccccttcccttttttgcctttttcttcctggttttgtacataactgaacattttgattttgggatgagaggatattagttcattctcacattgctataaagaactatctgagactgggtattttttaaatttttaaaaatttaatttaatttaatttaatttaattttatttatttatttttttgagatggagtctcgctctgtcacccaggctggagtccagtggcgccatcttcgctcactgtaagctccacctcccgggtttacgccattctcctgcctcagcctcccgagttgctgggactacaggcacccgccaccatgcctggctaattttttgtatttttaaatagagacgggatttcaccatgctagccaggatggtctcgatctcctgacctcatgatccacccgcctcggccttccaaagtgctgggattacaggcgtgagccaccacgcccagcctatttatttatttttttgagacagagtctccctgtgttgcccaggttggagtgcagtggcatggtctctgctcactgcaacctccacctccccggttcaagcgattcttctgcctcagcctcctgagtagctgggattacaggtgcctgccaccacgcccggctaatttttatagttttagtagagacggggtttcaccatattggccaggctggtctggaactcctgacctcgtgatccacctgccttggcctcctaatgtgctgggattacaggcgtgagccaccgcgtctggcctgtttttttgtttatttccataggttttgggggaacaggtggtatttggttatatgagtaaattatttcgtggtgatttgtaagttttggtggatccatcacccgagcagtatacactgaacccaatttgtagtcttttatccctcactcacttcctatcctttccccctgagtccccaaagtctattgtatctttttttttttttttttgagacagagtctcacgctgtcacccaggctggagtgcagtggcgcgatctcggctcactgcaagctctgtctcctgggttcatgccattctccttcctcagcctcccgagtagctgggactacaggcgcctgccaccatgcctggctaatttttttgtatttttagtagagacagggtttcaccgtgttagccaggatggtctcgatctcctgacctcatgatccgcccgcctcggcctcccaaagtgttgagattacaggcatgagccaccgtgccgggccttgtatcattcttaagactttgcatcctcataggttagctcccacttatgagtgaaaacatagatgtttggttttccattcctgatttacttcacttaggataagagtgagactaagtaatttataaagcgctgggattagaggcgtgagccatggtgcctggccaatgtctggcatcttttctttggtgtaatgttttgagattcatccatggttttgcatttatcaatagcgtatttcttttgtgttgttcagtagcattccattgtgtggagagacgacatttagtttcaccattttagctgttgagagacatttgggttgttttcaacttttggctattattcataaacctgcatgaacctgttatacacaattgtgtaggagtcttttatgtggaccaatgccttcatatctcttgaggttatatcctggagcagaatggatgagttgtgtagtagaagtgtgtataaggagtgggcaggccaggtgcggtggctcatgcttgtaatcctagcactttgggaggctgaggcgggtggatcacttgaggtcagcagttcaagaccagcctggccaacgtggtgaaaccccgtctctactcaaaatacaaaaattagccgggtgtggtggtgggcacctataatccaagctatggtgggagaattgcttgaatccagcaggtggaggttgcagtgagctgagatcgcaccactgcactccagcctgggtaacaaagcaagactctgtctttaaaaaaaaaaaaaaaaaaaggaaaggccagattgttttcctaagtggttggagtctgttatatttccaccagcaatgtatgagagttctaattgctccacatccttagcagcacttaatatttattgtcaatctttattattattattgttattattatttttagagataggatcttactctgttgcccaggctggagttcactgcagccctgaactcctgggctcaagtaatcctcccacctcggcctcctgagtagcttggattacaagcacacatcactacacccagctaattttatttttgtaaagatgaggtctcactaccttgcccaggctggtcttgaacccctgggatctcaagcaatctccctcctcatccttccaaagtgttggattacaggcgagagctgcagcgcctggcccctttcactttcttaacagtatctttgaaaagcagctgatttttcacagggtgttgtaattaatttaattagctccacactgtggctttgaaaatcttccgtaagctctagcgccagacacatggatatttgcagaatcttattttctagagtcctggaaattttctttcctgtgagagagttgagagcgataattttagggtggttattcatcttcagacacaaggagtaagaatgtagggagttcgtgactgtgtttggagaggggagagcatagcagtggtctaatgatcttctcagggttctcaaagggtggacgagctgcaggttgaaacttgccttgcttttagactgttgactgagtttgtagttaagcagataagtgccaaaggagaagtcagggctgactgattgcaagtgatgattgaatactggccctcacaaccatctgtgaaaagtctatttccagaaattttttttattttgttattattattattattattttttgagacggagtctttctctgtcgcccagtctggagtgcagtgatgcaatttcagctcactgcaagctccgcctcccgggttcacgccattctcctgcctcagcctcccaagtagctgggactacaggtgccctccaccacacctggctaattttttgtatttttcgtagagatggggtttcatcatgttagtcaggatggtgtcgatctcctgacctcgtgtccacccgcctcggcctcccaaagtgttgggattacaggcatgagccactgcgccgggcccagaaatatttttaagaagagatttttgaaaaacccttgttttcatgatgggaggatatgaaaagcagtgttttgaaatctcctccttagatcctgatactcggaactgtcgattctcccattttcattttctcctggatagattgtacacttgtgccttggtatcttcaatgattccaaaacccccctggggatccagtccctgacataaaatggcgtagtgtttgtacataacctacatacatcctcctgtatactttaaatcatcttggtctggcagtgtggctcacacttgtaatcccagcacattgggaagcagaggtgggaggattacttgagcccaggacttcaagaccagcctgggcaacatggcgagacccccatctctacaaaaaatttaaaaattaattgggtgtagtggcatgtgcctgtagtcccagctactcaggaggctgagacgggaagattgcttgagccagggagttccaggctgcagtgagttatgatcgcaccactacactccagcctgggcaacaaagaaagaccccatttccatttaaaataataggggccagatgcagtgactgatgcctgtaatcccagccctttgggagcctgaggtgggcggatcatcacttgaggtcaggagtttgagaccagcctgcccaacatagtgaaaccccatctctactaaaaataaaaaaaattagctggacaccatagcgcgcctgtggtcccagctactagggaggctgaggcaggagaatcacttgaacctgggaggtggaggttgcagtgagccgagattgcgccactgcaccactccagcctgtgtgacagaatgtgacagaatgcgggcacatcacgagatcaggagatcgagaccatcctggcgaacatggtgaaaccctgtctctactaaaaatacaaaaaaattagccgggtgtggtggcgggcgcctgtagtcccagctgctcaggaggctgaggcaggagaatggcgtgaacccagggggcggagcttgcagtgagcggagatcgtgccactgcactccagcctgggcaacacagcgagactgcgtctcaaaaaaaaaaaaaaaaaaaaaaaaagacagaaaaagaaaaaacaaaagacgtttagctttcctgggtgacccagtgttgcagggattggccatccttggtataaggcataggatgtgcagggtagcaggacagcagagtgggcagtgtgtggggtttctttcattgatagggtggttcccagcactcggggtcagggcttgcttgtagaagtttctgaaaagttgcagtcatgtttcatttctttctccccctacctagcacatgccaggccacacagcatagtacgatggtttggaaccaggcttaacctgttagtagccgtggggctctgggcaagtccactggagttctccgggatctgtttcctcttttgtaaaatgggaaccaaaaggtatcacaggctgggcatggtggctcacgcctgtaatcccagcactttgggaggctgaggtgggtggatcacctgaggtcaggagtccaagaccagcctggccaacatggtgaaaccccgtctctattaaaaatacaaaaattagccaggtgtggtggctggtgcctgtaatcccagctactcaggaggctgaggcaggagaatcacttgaacccaggaagcggaggttgcagtgagccgagatggcgaggtggcgccactgcactttagcctgggtgacagagggagactgtctcaaaaaatcaacaccaaaaccaaacccaacatgtatcacaagctcgttgtgaggatcagagaagaggatacgggaatgataaacatggtagttacattgttgctagcattgtagttatattgcagctgtacattgtgacctattgtagctactgttatttctttgattaagtttagcaactgaaattttttttttttgagacggagtcttgcactgttgcccaggctggagtgcagtggcgggatctcggctcactgcaagctccgcctcccgggttcacgccattctcctgcctcagcctcccaagtagctgggactacaggcgcctgccaccacgcctggctgattttttgtagtttaagtagagacagggtttcatcttgttagccaggatggtctcgatctcctgacctcgtgatccaccctcagcctcccaaagtgctgagattacaggtgcgagccactgggcccggccaacaactgaaatatttaacatacaataaaatgcacatggccggggtgcagtggctcacgcctgtcatcccaacactttgacaggctgaggcaggcagatcacttgaggtcgggaatttgaaaccagcctggccaactactaaaaatacaaaaattagccagacgtgatggtgcgttcctgtaatcccagctactcaggaggctgaggcaggagaatcgcttaaacccaggaggcggaggttgcagtgagccaagatcaggccattgtactccagccggggtgacagaaggagactctgtctcaaaataaataaaataaaataaaatgcacagatctgaagcattgagttcaatgaattttgacaaaaaatatatgcacctgtgtaaccaccactgaaaacaaaatggaggacattgcctcatcccagccctttccagtgaattcccagtacccccgggaatgaggtgttacaatgattactatcaccattgttgattattattgtttagtttggttttattgaagaagcgggtagagaaagaaatagttagcctcatgcaaaaagtagggcatatgagagcctgagatatggcttaagaagagtattgtttgagaagtttggctgagtgtggtggcttatgcctgtaatcccagcacttcgggaggctgaggtgggagaattgcttgagctcaggagttcaagaatagcctgggcaacatagtgagactctgtctctataattaaaaaaaaaaaaagagacagaaaagtttaaggtatgttggcaggtagtcctagatggggtttactgccaggagcagttaggattcaaagagcaaaaatttgagggtaaaaggatgtatggcaggttgttggtggtggatatatagccccaacatccagtcactttaaactcttatcaagacaacacagggccgggtgccgtggctcatgtctgtaatcccagcacaatgggaggccaaggtgggcagataactggtggtcagcagttcgagaccagcctgaccaacatggtgaaaccctgtctctactaaaaatacaaaaattagcagggcgtggtgttggggacctgtaatcccagctactcaggaggctgaggcaggacaatcacttgaacctgggagatggaggttgcagagagcagagatcacaccaccgcactagagcctgggcgaaagagagagactccatctcaaaaaaaaaaaaaaaaaaaaaaacaaaaaacaccaccaaaaacaagacaacacaaagcgtttgaacgaaaacagcatttgcagatgcaaattcaggatccgaaattaattcttcccccctctttgctgagctgccagaatgttccaaggagatccctcctttccagtttcctccgtggcgcacaggctgtgccgagtaagtgggcaattgtgagtttctggaaatcagcgagctggtgtggctcctggctcctggctctggccaagggagttggcttccctgtgtccatgccaggaggggaggctggaggcttctaaaggccgcagctccgctgtagacacgcgcctccttggcactggctttgttgaaatctgtccctagatagtctctcttctgcacagacctctgaggtttttccatactgcaaagggccttgctgcaggaggaacagtctgacctaatctctcctagaggaggccttgagctaatattttttattttttttttatttttgagatggagtctcactgtcacccaggctggagtgcagtggtgcaatctcagtccactgcaatctccgcctctcggattcaagcgattctccctgcctcagcctcccaagtagctgggattgcagatgcccgccaccacacccggctaatttttgtatttttagtcgagatggggtttcaccatgttggccaggctggtctcgaactcctgacctcaggtgatccacctgccttggcctcccaaagtgctgggatgacaggcatgaagcacctcacccagccaaggtaatatttctgaaaggtggagtaccatgctatgagctagacacttggtgtggtttatcctgtcatcgcctcagtgacctcaccaggtggacactgttaggattcctaatttgcagagggagaagttgaggctgacagaaaggtcagcactgtgctcaaagtgatccagctgctaccaagatgaactgcaggctttgctctgagctcacagcctgacctcagtctagagctgggaatctttctctccctcattgctacacctgatcaattactgagtcccatccctttaactgcttacatggccttcaaatccatcttccctacctaagctgcccattcattgacctgtgccttctgtccatctgctgagagccaggtgctgtgcgagcctctgagaatgtggccgagaacaatatggataaaagttctgagccgggtacgctgactcatgtctgtaaacccagtgttttgggaggttgaggcagaagacttccttgaagccaggagtttgaggccggcctggacaacacagcaagaccccatctttacaaaaacaaaaacaaacaaacaaaaaaaagaaaaagaaaaattagctgagcatggtggcactgacttgtggtctcagctacttgggaggctgaggtgggagcatcacttgactccaggagttcgaggctgcagtgagccatgactgtgccactgcactccagcctgggcaatagagcaagaccctgtctcaaaaaaaaaaaaaaaaaaaaaaagactgtaaatgtatcctccagagtaattcttctttttcatttttcaaaagcatccttgctttgtttatgcttccaaaagtttaaaaactgtagctaagttccaagaaagaaaaagggaagcaaaggaaaaggaaaacacagacccagaggccctttatggggttgattgtatgtgaagtccataaattgatggagagaaggagcaccttggcagtatttacttgtactctcctatgtcatggatttcctctccattttcccaagggttctttcctgttcttagaaatgttttgtgattttgcttcagacacagtttgtctacttcttgtaagcattgttcttagattgctggctttatatctatcactcccttgctcatctgcccatccatctatccatccatccatccatccatccatccatccatctatccatccatccatccatccatccatccatcatccctccatccacttgctcatctgcccatccatccatccatctatccattcatccagtccattcaccacccaccatctattatccatccatccatccatccattcatccactcacccattcatccatcatccatccactcacccatccattcattcagtcacccttcatccattcactcacccatccatccatccactcatccaatcacccatccatccatacatccactcatccattcatccatccatacatccactcatccattcatccatccatccacccacccagacgtccatccatccatccatccatccatccttctgtctactctgccaacaatccacacacctgtccctccatcccttccaaccactcacccagcaatcttctcatccatctatccacccatgcatacatccacttattcattcatccatccctccacccacccattcatccacccatccatgtgtccattcatctctccatctatccgtgtgtctatcatctaatataagggagatgttttgaagtattaaaagtgattattttgtagcataggggacagggattgtgttttctttacttactgctaccttattaaatgcttactagttctaaaagccctgcaattgattcccttcaattttccaactctataattgcagcatctgcagataatgatgacttcttgccttttgccaataattagaccagttattgctgttaaccttgttatggcaggaacttccagaacagtgttcagtgacgcagctgaatatggtcagcccagtctcatttctgatttgagtggaatgcctcaattgttttactgcagaggataattatataattgttaatactcttgaccttcctgtctttagcctcactgagtaaatggggtgtgatcatgaaatcttgattgtctcatagatgcaagagacataaacgacatttgtctgtgtataatgacagcagatttattttgctaagctgttaagctgttaaaataagcctttaagcccccgcctcaattttccagcagagtggaatgttattttgttgcttctggccaagtgtcgatattcattttagggcaggtcttcatggaaagtctgctggactataggtctggatacttgccggaccctgtgtcatcactaaagttagggtgcgtttcagaaccaccctgtaccacagtgaagagggacaaatggccttagggagcaggacccatgggggccctctggggctgtttcttgtgccctgagagaggccctagatttgggacagtctgatttacctcccctcccttttttttttctgggtgatgctaccctggtttctgtgttgaaatatgaccctagtgtgaaggtcgcggtctcagaccatcttgtttctggtatgttaagaaacagaaaaacaccttttaggacacaatgttaaccattgaggatacatatcagtgttctggaaaaacaaaaacaaaaacaaaacaatctgtaccgcgactgtggttttcatcagggtgggctgcctttccgatccataaccctgtgtggcttgatggagaacatgttttgtaacttgcaagggcatctgcaatagccgggtcctcttggtgaaaggggaggacccacattaggtctaagctggctggagtcgatgcaaaactctcacatgctttggaaaaagcacgtgatctttcgacgagaatgcaaatgttgaccgggtgcagtggctcatgcctgtatttgcagcatttggggagactgaggcaagcggatcgcttgagtccagaagtttgagaccagcctgggcaacttggtgaaaccccatctctacaaaaaatacaaaaattaaccaggtgtggtagtgcatgcctgtagtcccagctacttgagaggctgagttgagaggattgcttgagctcaggaggttgaggctgcggtgagctgtgatcacgccactgcactccagcctgggcaacagagccagaccctgtctttaaaaaaaaaaaaagaatgcaaatgtttgcttgattattcagctggtatttgacacacagttctttgttccagagggactgtccagcaacaaatagtgaattcgttaatttttcacaccaaacctattgaaaataaccagaaaaggtatatgctggaaaactcagtgttctagaaacattcatgtttgccatcccaagagcaaaagtcatggaatgcctgatgcttagtgttaagaggaaggaattccacacagcctgtggctagcttttcttatttcattggtgtccaagacaagatttgaactgtttactaaaggaaattagcatcataagtctcctctggcatatatttccagcatccaagtggagctgctgagatcttgctcaagagtagcaaaattggcaggaggaggagggcattagtttttacatcagcttaaagaattttttttatcagccatttttgcaatttggaaacctgtttggagtaggggtatatggagatgaaattgggctgtttctaggattcacctcctccttcaggcattttttttttttttttggaaacagggtctggctctgttgcccaggctggtgtgcagtggcgtgatcatggcttactgtagccttgacctcttgggctcaagcaatcctcccacttcagcttcccgagtagctgggaccacaggtgtacaccatcgcacctggctaatttttatatattttttgtagagatggggtctcactatgttgccagggatggtcttgacctctcaggctcaagcaactctcctgcctcggcctcccaaattgctgggattacaggcaggagccactgcagttggtacttagagttgttttttttttttttttttttcccttgagacggagtctcactctgttgccaggctggagtgcagtggtgcgatcttggctcactgcaacctccacctcctaggttcaaaccattctcctgcctcagcctcctgagtagctgggactacaggcacacgccaccatgcccagctaatttttttttgtatttttagtagagatgtggtttcaccatgttggccaggatggtctcgatctcttgacctcgtgatcctcccacctcggcctcccaaagtgctgggattacaggcgtgaggcaccacactaggccgatcctcagacatttttaattttccttttttagtgttacagccagccatttgaaaaatgagacttccccctaaccttgtgtcaaactcagagacgttgtcatcttggctttgatgtggtggaggagaggggcttctcattccgggacggggtttctccacctggggcctgcggatactggggctggattgttctctggggtggggccgtcctgggcactgagggtgctagcagcatccctggcttccacccattccatgcctggagcgccgcccccgaggcatggcaaacacaaatgtctccagacactgccaggtgtctcctggtgggcagaatcgcctccatttgaggacccctggaccagggtgctggaatgggggtgaggggcactctgcaattattctctgctctttttttgaggggggggaaatggaaaccaagagcccatcatcagcctcgtggctctgtggtttgacactgccatgctaccgacaaaaaccacgtccctagacttgggggaccaaggaatctggaggaatatgatgatagtcatttaatgaaggtgggtttatgtattactcaagtgctgggctggggagtcaggacatagccacagggaagaaaacagaaaggtccttccctcttggaagcccctcttgaaacacctaattggtgacatggtacactggagaatcagagagtgtcactcaagcattttggcttggtggtggggcgggggtggcgggtcaggcactcaagcacccctaagctgatctggagaaagtgtcggggaaggggaacattagcgtttctccctgaggaatcatcttacacctataacggcaactggcccacagtaacattgatggagcaagtgtcttcttgtggctcggccgctcaatagctgtgtgaccatgggcaggttactgaacctctctgtgcctcagtcttctcctctgtaaaatgggaacatctaggattgttgggggaaataaatggttaataattggaatagtgctgggtgcataggaaactctaagtgttacacagcatgtggccacaacctcccctctcccctcctctctcctctttgctgctgccctgctgccttaatgggatactcccctctctgtctctgtctgtctgtctgtctgtctgtctctctctcatccccttttctttcctctgttcccccacccccacctctgatgcagtttggaccaagttttcttcagccagctaatttagagacaagaacctggatatttattgggcgtttgggggacttccttacagccctaggtctctgtgaaaagggccctggattatctctgcaaaagcccacctgctattggttagccaggactgtctccactttcagacaccagcttcatccaaacactctttgctgtatttataaccacggtgcatttcctcgggacgcacatcttacggcttcttggccccttcgcccagggtgcactgcctggaccatcgccctccggcagagacagtgtctttctttgtatgttctccttcctctggtcgagatgtggcttggtcacctggagtggggccgtcggcaagtcgcctgggcttcgtggaggctcgctgcccccatggcggaaagctcggccacacaccctgatgtctcgacacctttgagttgcccatgaatgggttttcagagcttcccgtgtttacttcgctgcacgcctctgtttgtgctctggggaaattcttggcagaggaaaagccaattggaaaacagccctgcttggtgtcagggcttgaggttgagggagaaagactgaaacggagatttgcatgagctggtttgagcatgtcacaagactttgtctttaaaaaaaaaaaaaaaaaaattggcctggtgtggtagctcactcctgtaatcccagcactttgggaggctgaggcaggcggatcacgaggtcaagagatcgagaccatcctggccaacgtggtgaaaccccgtctctactaaaaatacaaaaattagctgggtgtggtggtgtacgcctgtagtcccagctactggaggctgaggtgggagaacggcttgaacccaagagggagaggttgcagtgagccgagatcatgccactgcactccagcctgggtggcagagcgagactggtctcaaaaaaaaaaaaaatttttttttgttccagtctattctggtggcttagaggagggaagatgggaaattttgggtttaatagagtaatatccatcaggttgagggctttgaagcacctgggaatatccataagtcactactgagcaccagctgtatagagttattgagcatgtattgtctcccaggcacatggtcctcacaacaatcttttcacagagctaggatttgaacccacagtctctctggcttcagaaccctagcttttcttgctatactctgccttacagaggaagggaacttttgtactgggttttgaagggtgaataggagttcaatgaagaagcagcacattctgtgctaaatttggcttcctgatcctcctagaattggccagaagccaatatctggaggccaaaattgggtcactagggtgaccaactcatcacagggccctggattatctctgcaaaagcccacctgctactggttagccaggaccatcacagtgtgcccaggtaaccctgcgtttcaccccaaagcagaattttacaccagagcctggacaccagttgaattttctttaactcatttctgtcaatggttacctccaaaaatgctcccttgtgtctttatgctgggcttctttctctagatacttccatttcttggtttgggtgaaaatcaaatgaggtaattaatgcttgtgacatgtaaagtgtagtgagtggcacatggtaacctctttagttttagccagttggttttttttgtttgtttgtctttgagacagagtctcactctgtcacccacgctggagtgcagtggcgcagtctcagctcactgcaacctctgcctcccaggttcaagcaattctcctgcctcagcctcccgagtagctgggattacaggtgcacgccaccacactgggctaatttttgtattgttagtagagatggtgttttgccatgctggccaggctggtctcaaactcctgacctcaggtgatccgccctccttagtctcccaaagtgctggcattacaggcatgagccacagtgcccagacagttttagccagtttttcactggcctccctctttgccttttttgcaagggagctggcctccctgtccctggagtaagcaaacttccttatacctatagcttcctctaaggaagcgtagttacctacagcctggccctccccaaggacacagctgtttcctccaccaagagcaaggagtggacataatcactgccaaatagggaagccaggctggacaccgtggctcatgcctgtaatcccagcactttgggaggccgaggtgggaggatcacttgaggccagggattcaagaccaacctgggcaatgtagcaagaccctgtctctaaacaaataaaaaaattagccagctgtggtggcccatggctgtagtcccagctactccagaggctgaagcaggaggattgcttgaccgcaggagtttgatgctgcagtgagctacggtcacaccactgaacaccagccaggacaacagagcaagaccctgtctcttaaaaaaacaaaaaaataaggaagccagatgggtgctgggtgtacgggacacatgtcaaaagtcagacctctatctgagtaaggaaacaggttcagagtcaggattaaagaccaagacagcttgaggtcatcagaggccaggaatttccatacaggctgcggtccaaagtgccaagctgggctagatagatgttggggaagagtctctgtcgccctctttccttccccgttaatgctatcagctgagcatgggtcactcctgattttttttttttttttttttaccgaggacataggctcagagtgtcttctagctttcaacccaccccagactctgacttagcctttcccaaatggtgctgtgcagaaaaatgaaaaaattgctaggaggatcatgtgcctggtggatagtacatgcttgatagctgtaaacagttggtgctcaatatatcgtggcttgtggatcttcccagctgcttcagaaccccaagcctgctgtataattgtacttgatcccgacaacagccctgccagatgggtgttactctgattcctgtgtcctggtaagtggacggggggcctggagtagctgaattgcctagagaaggggacatagctagaaaggaaaagttgaaacccagtgtgatgccagagtccatgcaaactttatcctgaaaggagggatctctttttttttttttctgagatggaatctcactctgtagcccaggctggagtgcagtggtgtgatctcggctcactgcaacctccgcctctcaggttcaagcgattctcctgcctcagcgtcccaagtagctgggattacagacgtgtgccaccacaaccggctcatttttgtgtttttagtagggacggggtttcgccgtgctggccaggctggtctcgaactcctgacctcaggtgatccgcccgcctcggcctcccaaagtgctgggattacaggcgtggccactgcgcccagccttcttcttcttcttcttctttcctcctcctcctcctcctcctcctccttttttttgacagagtctcactctattgcccaggctcgagtgcagtggcacaatctcagctcactgcaacctctgcctcctgggttcaagagattctcccacttcagcctcccgagtagctgggattacaggtgcgcaacaccacagccggttaatttttgtgtttttggtagaaacggggtctcgccacgttggccaggttagtctcaaactcctcacctcaagtgatccgcccgcctcagcctcccaaagtgctgggattacaggcgtgagccactgcgctcggcctggtgaagaccttcttgccggtggggactctgcagagtcctgacagggagcagggcatcacatggcgagggagctgagagtgtcagctcaggtctctcttcctcttcttataaaaccaccagtcccactcctatgataaaccattaatccatgaatggattaatccacttatgaggacacagcccttttaatcacctctgaaaggccccacctctcaatgctgccacatgaggaattacatttcaacatgagttttggaggggacaaatattcaaatcatactattatgttaccagtaaaatttaaaatataggaataataattgccgatgtgtggcagacttaccaaatactagaccctgtgctaagtgttttatatctattattttatttaattttcttggtcactgcataacatatgctctgttagtcccagtttttcgaatgggcataacaagaccgaacctacctagagttggcacaagttgtaaaaataggatccgtggccgggcacagtggctcacacttgtaattccagcactttaggaggccaaggcgggaggatcacctgaggtcaggagttcgagaccagcctggccaacatggcgaaaccccgtctctacttaaaatacaaaaattagccaggcgtggtggcgcgcctgtagccccagctcctcgggaaactgaggcaggagactcgtttgaacccgggaggcggaggttgcagtgagccaagatcgcaccactgcactccaggctgggcgacagagcgagactccatctcaaaaataaaataaaacaaaaaaataggattcacttttgccaccaacttgaaaaggaggcaaacacaagattactcatctctggagaggaggcattcagatttgcctactcagcattcctggagatagaaccagattttgcatgggttagaatcatattttgcttgggaagccactcagacctcattgtgtggactctattcccagagccagcttcctttattccttcagactcttatgattggctcaggggaaggcacatgactcagactgggccaatcagctttcttaattcctccagcctccatgattggttcaggggtgggcatgtgaccccagaaggttccataagattcagttctgggactttagtgggagtgatagagagatttttccttgctaaatcttccttgctgtgaagctataatccaggtgccaccatgtagagaccacgtgtctcagacttctgacaccatagaaggaagcaggactgcgaaaaggaaagggagagagatggggtccccatgacatcatttgacacctggatctagctgtacctgaaagtgtccttgtcctatgacttgttagttaaatgagccagcaatcgttcttttcttttttttcattttctttctttcccttccttccctccttccctccttcctttcctttcttttcctttccctccctccttccctccctcccttccttccttctctctctcttccctcccttccttccttccttctctctcccccttccctccctccctcccttccttccttccttctttccttcgttccctccctccctccttccttccttccctccctcccttttctctctctctctctcttctttctctctgtataactgagctttctattctcacaaactgaaagaggtcttgctaatccaaggcatgacaatcagagcaacatgtgaagcccaaagagctgcagagctcccctccatggcttccagccccgggggtggtcagtgaaagtaactggagcccggagcttcagaggccagtgtggaggttggaaaggttgtggtcaggagagagtaatatatctggtccctgcaacagacacccctgcagttttatcctgaatcctgggtaatttccccaggtcctgggaagcctaataaagcccctactcagatgttggattgcaagtcctttttgtttgtttgttttttaaatccactttaaatatgtctgaaaaccacacacagagtgactgctgcacagaagagcgaatggttcatgccttcttctttgctgccaccaacaagtcagttacctacttctctgacatgggacccttggctggagctcactggctgccttcctgccacctgtaagcctcggcacttgctgttccctctacctacatgcttttccctgtgatacttcctcatacgatttcctcagattatctttgctcaaacaacaggcaagggctgggccttaatctcacacctgtaatctcagcactttgggaggccaaggcaggtggatcacctggggtcaggagttggagaccagcctggccaacatggcgaaaccccatctgtacaaaaaatatacaaaaaattaaccagatgtggcagcgggtgcctctgatcccagggacttgggtggctgaggcaggagaatcacttaaacccaggaggcagaggttgcagtgagccgagatcatgccactgcactccagcctgggcaacagagcgagacttcgtttcataaaaacaaagaaacaaacaaacagaaaaaaacaacaaaacaaacaaacagaaaaaaccaacaaaacaaaaaacaagaggcaagaagttcagtgtgcagaatctctgagaaaaacccatggttgttaaccccaggtctgccccttttgagcagggtgacattaggcaactgatttgatttctcttagatgaaatttcctcactccctgcctattcaaccacagtactgaggacatttggagctggattatctctctggtggcagctgtcctgggcattttagggtgtttactagcatccctggcctccccccactagataccagtagcactcccaccccacactggttgcaacaaccagaaatgtctccaagacacttccacgtgacccccggggggtcagaatttctccccttccccctgtgttttcctatggaggtggaacgtgtttatttctttgctcaccgttttgcaatctctcttcccccgccacaaggcagggactcttctatctccgtcaccatcccatcctcccacagtggagacagctctggggactctcctgagcagcagattcttgggtgccacattctgttccattcctggggaatttatctctttactgagtgatgggtacatgagaactttctgtgtcacccttgcatcttttctgttttgtttttacaaaagaaaaaaaagaaggccgggtgcggtggcttacgcctgtaatcccagcactttgggaggccaaggcgggtggatcacgaggtcaggagatcgagaccatcctggctaacacggtgaaaccccgtctctactaaaaatacaaaaaattagccaggtgtggtggcgggctcctgtagtcccacctacttgggaggctgaggcaggagaatggcatgaacctgggaggcggagcttgcggtgagccaagatcgtgcccactgcactccagcctggcagacagagcgagactccgtctcaaaaaagaaaaaaagaaaaaagatatcactcgatgactgctaccgaaacattctgtggctgggagaggaaaataccagaaagggtgaatgtggtcggttgaatgatgcctctcccttcccccagagatgcccacatcgtaatccctgtcacctgtgaatttggtacctcacttggcacaaggctctttgcagatgtgattaagttgaggatcttgagacggggggatgatcctagattatctggtgcaccaaatgccatcgcagggatccttttcaaggaaagagggaggcaagagattgaaatgctacggccaagaaaaaggagctgccttaaaagctggattctctctggagcctccagaaggaaccaacctttgtaacatcttgattttagccctgtaagactcattttgggcttttcaccaccaaaactgtaagaaaataggcaggccatgatggttcatgcctgtaatgccagtactttgggaggccaaggtgggacgatttcttgaggctaggagtttgagaccagtgtgggcaacatagcaagaccccatctctacaaaaaaaaaaaaaagaagaagaagaagaagaaaaattagctgggcttggtggcacacatctatattcccagctacttgggaggttgaggtgggaggattgcttgagcccaggagttcgaggctgcagtgagccatgattgcaccattgcactccagcctaggcaacagagtaagatcccgatgcaggagaaaataataaatgtatgtcgttttacatttgtgggcgtttgtgacagcagcaatgggaaatggatacggtgagaaacccagcacctgggcctggaaaccccctctgggcgggtctctagccaggggccaacaggagtcagagcagggccttggtgagaggtggatacggggccccagcatcctgatggccttgctgtggcttctggggacacctgcagtggctccattacaccgtggcaatttgttccttcccagaccccctggatacaaggggcctgcattttcgaacccagagcccggggacatcccccgtggttccctgttaccctctggatgtctgtcctgctactatgcacctctccccaactcctggtacacagtgggagttcaggggccgtctcatttgtaccgcataacatcacggaggtccaagacgccatgtaatattctgtttaggatttcagaggcacagtcagttacatccatcttctttttgtctttgagacagagtcttgctctcttgcccaggctggagtgcaatggcacgatctcagctcactgcaacctctgcctcctgggtttaagcaattctcttgactcagcctcccaagtagctgggattacaggtgcacgccaccacacctggctaattttttgtacttttagtagagacggggtttcaccatgttggtcaggctgatctagaactcctgacctcaggtggtccactcaccttggcctcccaaagtgctgggattataggcgtgagccaccgtgcccagcctgcttccatcttcttagccacttttccctcaggtgagaccatgagattaggaacctgtttcaattcccgtcggaatttcccaacagagctggggctttgtgattcgaatatgttcagagaaggaagcagaaggaagcagaaatgaaggatgttatcagaaaaggagactcagggttgggtgtggtggctcacgcctgtaatcccagcactttgggaggccaaggtgagtggatcacctgaggtcaggagtttgagaccagccaggccaacatggtaaaaccctgtctctactaaaaattacaaaaattagccaggcgtggtggcatgcgcctgtaattcaagctactcgggagactgaggcaggagaatcacttgaacccgggaggcgaaggttgcagtgagccaagatcatgccactgcactccagcctgggtgacagagcaagactccatctcaaaaaaataaataaataaataaataaatacaggaaaaggaagctcggtagttttcaggggctgctggcgtttccaagctttaggcattttgctttgagtctttttctgtctttcgagtcatcctgaagtggaaccgagagaggactgagtgggtggagggggtggtggtggggacggctgtctgctctgctggaattgagagtctgggagatcattgtggtgtttttggagtgattcttaaccccagatatagacagtgacacaaggggcataaatacgaggaacagtgaccttccctggtgtccttgtttgaagcatttgaccatctgggcaaggcctgggagtgtctgaactggctggtgcttccatgaacaagcacagactcagagcccatggtcctgggttcgaatcctagttcttccacttctttgctgtatgacctttgtctacaaaaaataaaaatttagccaggcacagtggcgtgtgcctgtagccccagctactcgggaggctgaggcaggaagatccattgagcccaggggtcgaggctgtagtgagctatgattgcaccactgcactccagcctgggcaacagaagcagaccctgaagaaagaaagaagctgggaagacagggaagaaggaaggaagaaaggagggagggagaggggaaggaaggaaggaaaaaaaagggagggaacaaggaaggaaggaaggaggtggggacggagggaagaaggaaggaaggagggagggaaggaaggaaagggagggaggggagggaggagggagggagggaagaaaaaaagggaagggaaggaactttggaactactgaacatctctgtttcctcatctataaaaagagggataagtcatcatcatatcttcctctatggtcattgagtggatgaaataagacagcatttgcaaatcccctaatgcatacctggcccctgattttgttccttgggctgcagcgatgatagaggtttaaaacctccaaacgctgtgttgaaatctctcacgtggacaaccagcccaccagcagagaatgtcatttttccatcctgggtaaacagggtagagaagaatgaggacctcaggccaggttagagagacctcgcttggtgaccttgggaaggcttttaacttttaactttaatgctaacatctggttccctccagttaggcagtcggcggcctagccgtcttgtcttgaagtttctcttgccttccatcatgggtttatttgttcagcaaatgtttatggagggccagcacaggggggaataagaactagagttctgggaggacgtgtgaagaaacaagttccgagccccagggaggaaagaggtcattgcctccctctggggaaaatgtctcttctcatacctggttcacttcttaaatggaatttcccccttcagatgagtaaggcgtttaatcacaaagagaaaacaccttcatcacatagccatccttaaaaggcatttattgtgaagctggttcatagacttctcgcccaggttgctaacagccaacctgtctgggttttgggaagttaaagtgtctgtatcccatttcctttttttttttgagacaaagtcttgccctgtcacctagcctggagtgcaatggcacaatctctgctcactgaaacctctgcctcccgggttcaagcgattctcctgcctcagccctcccgcgtagctgagattgcaggcgtgcaccaccacgcctggctaattttttgtatctttactagagatggggtttcaccatgttggtcaggctggtctcgaactcctgacttcgtgactcaccagcctcagcctcccaaagggctgggatgacaggcgtgagccactgtgcccagccagttctgactttttaacttgtgatttgacttttcctgtctgaagtctttctctgctggacgtgagttgttgaaggtgttgcttttctttgtagacaattagaggcgctcatgcactgggctatggacaataatactttgaagatgtgcaaatgatttgcaacctttgttgcataaattatccctctgagatgctgtttggcttgataaataaaggacctgcaagagagaatttatcttgagcattccttgggggagagaagcaaaggggaagtgaatgctgcataataattctttgcatactttatggagggtgggttcctgcagtgccctgtagggttttttgtttgttttttttttttttttttgagatggagtcgctctgtagcccaggctggagtgcaatggtgcgatcttggctcactgcaacctccgcctcccgggttcaagcgattctcctgcctcagcctgccaagtagctgggactacagacgtgctccaccacgcccagctaatttttgtatttttagtagagacagggtttcaccgtgttagccaggatggtctcgatctcctgacctcgtgatccgcccacttcggcctcccaaagtgctgggattacaggcgtgagccaccgcgcccggccccctgtagtggtttaaagcatcttcactgttattctaagcctcacattttaaacagagctgaaaaaggactctaattgctggcctgggatccttgtgtgctgtaggaattcactgagggggcggggctggagagggctgctagagggtggtacagaagcagatggaactttctctctggctggacacagtagctcacacctgtaatcccagcactttgggaggctgaggttggtggatcacctgaggtcaggagttcgagaccagcctggccaacatggtgaagccccgtctttactaaaaatacaaaaaattagcaggacgtgggggtgggtgcctgtagtcccaactacttgggaggctgaggcaggagaatcgcttgaacccgggaggtagagcttgcagtgagccgagatcatgccattgcactccagcctgggcaacaagagtgaaactccatctcaaaaaaacccaaaaataaatttaaagaaaaattttctctctgattctgcctgcctgcctgctagactggaagcaccatgaggtcaaggtccacgatgtcttgtcgctattgaagcgcctccaaaacatggcagaccctcagcaaatcttggacagatgaatgggcattcgattcaacatgtgtctgctaggtgggagctgagcgggaatcgcagggcttgggtcccggggatgatggggaatggcagtgtgactgtggggaagccaggggaatggggtgctggagcccccaaagctataaatcagggcctgatgaacagacagacagatggaccaacttaaccatttcagccccatcggctttgatgatttccctctggctctggcaagagtctcgctcaccaagtggttctcaccctagggtgggtctggatatttctggggacatctgtggttgtcacacgtcggggtggggggagatgctcctgacatggagtgggtggaggccagggatactgctcagcaccctgcaatgtacaagacggcccctccccagatgaagatccgactctgaataccaccagtcctgaggctgagaaaccctactttaagataacagtgatgggggaattatccaccccagagtctgagtctgtgacttgggaaacggccccggcattaccaggtgttgaattcgtgagaatacaaggagaaggcgtgtagcccgtgacccagtcctgccccagacaaaccgatattccctccaaagctctatttggcagaagaagtgttttcgttccctcttgcctgtggtatctcccctgataagcgttgtggattgttccagaccgtgttgacggggacagcttccttctccgcggctgccggccctgaccctgcagctttcagtctgtgggagtagagtcagctgttgagcagtttactctgtccctgtgtcaatgggattgtgcatgttttggttcctgaggggtcattgatggtgcacttttcttttgttgttagtcaatttaatttgttactaataataaaatctggaacttacctgaccccaaaggcccaggtcgttaagaatgcttggtggaatgcacgtccttttcaaataccggctcctttggaaaacacagaggatggagtgaaatccttacctggattgtactggcagtgggatgacagcgtcacctcctgaaaatggaatgtagcttattgctaaataagacagcgcagtgcctccctcgcacctgtcatcttggtgcttagagaggccaaggtgggaggaattctcgaggccaggagttcaaaaccagcctgggcaatacagaaagagcctatttctactacaaatataaaaattagctgggcatggtgacatgcacctgtagtcgcagctacatgggaggctgaggtgggagaatcgcttaagcccaggaagtcgaggctgcagtgagctgtgacttgctactgcactccagcccatgcagctgagcgagatcctctttcaaacaaaccagccaactaacaagcaggccccaaggggacaatttttctggaattacctgattgtatcaagaacagtttgatcaacacctgtaatcccagtactttgggaggacggatcacttgaggtcaggagttagagaccagcctcgccaacatggtgaaaccctgtctctactaaaaatataataattagctgggcatggtggtgggtggctgtaatcccagctacttgggaggcagaggcaggagaattgcttgaaaccgcgaggcagaggctgcagtgagctgagactgtaccactgcactccagcctgggccacagagtaagactctgtctctctctgtctctctgtctctgtctctctctctccatatatacatatatatttatatatataacttatcttgaagacggttttggcacgccttaacttttatgccagaggccagtgccttgcttgtgtcaccctggttccaagaatctgcatagtttttcccagcccattctacagacagggaaactgaggaccaggcacactaggttcccctccaggagtcgcacagcgaggagaaagtggagccatgacttgatgccaaacactgagactccagaacccatattttctcagctcttaggtttttgtcaatttcctaaatttgtgtgtgttttagtggggctgagtttctcctgttaatttgtttatggagaggagacactcttgtttacttttttttttttttttttgagacagagtctctgttgaccaggctgcagtgcaatggctcaatctcggctcactgcaacctccacctcctgggttcaagcgattctcctgcctcagcttcccgagcaactgggattacagtcacacaccaccacacctgactaatttttgtatttttagtagagatggggttttcccatgttgatcaggctggtctcaaactcctgacctcaggtgatccacccgcctcggcctcctaaagtgctgagattacgggtgtgagccactgcgcctggctcttggcgttctcccttagtaatacttcttgggggtcattttgaatctctgtttcttctgtggtcacgttcatttggaatttacttattcaacccacaaccaatagacatttccagccctttgttagtataaacagaacttctctttgactttcacagcgtttttgttctggaggtgctatccttgattgctaagacacccacgacattgctcttggaattggagtagggtggatgaaatagtattcaaagatgggggtggtgcaaatgttctgtatttcaacctgtacattagtcaagtgttatttttaccctcatgtacatctattatggaataaaatacatgactttggccaggcgtcatggctcacacctgtaatcccagcactttgggaggctgagacgggaggatcgcttgaatccaggagttcgagaccagcctgggcagcatagcaagaccccttctctaaaaaaaaaaaattagctgggcatggtggtgtgtgcctataatcccagttactcgagaggctgaggcaggaggatcagttaagcctgggaagtcgaggctgcagagagctgtgataggcagcctgggtgacagagaaagaccctgtctcaaaacaaaaaacaaaacaaaacatgacttttatggagttgagctcaacgtttgcatacacatgaggagcagaagctggaggtttcaaataaatatctggcttctgcaggctgcctggagagaggtgagagcgatgcattggtcacccagcctggagtgcagtggtgtgatcacagctcactgcagccttgaccttctgggcacaagcaatcctcctgcttcagcttcctgagtagctgggaccacaggtgtgtgccactatgcccagctaattttatttatttatttagagatggaatcttgctctgtcgcccaggctggaatgcagtggcacaatcttggctcactgcaacctctgcctcctgggttcaagcagttcccatgcctcagcctcctgagtagctgggatcacaggcatgtgccactatgcccagctaatttttttttttaatggagtcttgctctgttgccaggctggaatgcagtggcgccatcttggctcactgcaacttccaactcccctgttcaagcgattctcctgcttctgcctctcgagtagctgggattacaggcacgcgccaccatgcccagctaatttttgtatttttagtagagagggggtttcgcatgttggccaggatggtctcgatttcctgacctcgtgatccgcccacttcggcctcccaaagtgctgggattacaggcgtgagccactgcgcccagcctaatttttgtacccctagccgagacagggttttgccatgttatctaagctggtctcgagctcctgggctcaagcgatccacccgcctgggcctcccaaagtgctgggattacaggtgtgagccactgcgcccggccacagctgttgttttctcactggcttgagaattgttctcttaagctggtcaaggttatgacggtttgtgtggcctgtgcacgtgtgtgtggtcaaatcccatttttctaaagcaaagtttctatttgggtatctgctgtttaatttttcagggattttttttttccggttgctaaggaaagtacattaaattttatctttgtatcctgtagaactctttgtgaataatacacggccagagggaagataggctgaggaaacagataggaaggaagttcaagggggggatttctatgtgagaaccaagaaacacctttgatctttagatttcaaagtgggaagttcaaggtgaggtgggcgtggaattaggagtaaacccaagaagagcgagtgggcggttcctcctggcagccacagaatagttacgtggcatgaggtcagtagcatctcagagggtgttgttgtctttgacttagatgagttccaagaagcagaagttcgtgagccaaacacgaggtggttttctggggggtacaagggctggaagaggggccagctcttaaccacaaatccctttccatgcccaaggccaagctccttgtaactcttttctttctttgcctccctccctccctccctccctccttcccttccttccttccttccttccttccttccttccttcctttccttccttccttctcaaacaaggtctcactctatcacccaggctagagtgcaacggcacagtcatagctcattgcagcctcaaacccctgtgctcaagtgatcctcctgcctcaggccctcaagtagtttttaaacttgtttgtagagatgggtcttgctatattgcccaggcttgtctcgaacttctggtcttaagcgatcctcctgcctcagcctcccaaagtgctgggattacaggtgtgagccactggcccggcccattctcctttctttagccaggctagggagacataagtggggaaactcatgttgttttttgagatggttgctttattctcgtgatattttccctctttccaacttccttgagccctccccagcctcctcttagtgtctgtgtgtgggtgagggggctttggtataccttctgctttgggtctcattcattttaattttttattttgttttgttttgttttgttttgagatggagtctcactctgttgcccaggctggagtgcagtggcaccatcttggctcactgcaacctctgcctcccgggttcaagcgattctcctgcctcagcctcccgagcagctggggattacaggtgcatgccaccatgcctggctaatttttctatttttagcagagacaaggtttcaccatgttggccaggctggtctcgaactcccgacctcaggtgatctgcttgcctcagcctcccaaagtgctggggttacaggcgtgaaccaccgtgcctggccacgggtctcattcattttagttggagcccaaattcactggtggttcaagttcccaatcattctcggcattctataatcacaggcctcagagagtaatgctcccaatggccctcaaattatggtttccttaggaggctattaaatcttgatttctgagaggaaaattggggattttgtgttttcccttttagacttgagtgttctgttactgtggatgagctcttctagaaacttccaagcagtttcaaaggggatttagatgtcatcaggaagtgtggttgacaacgtgatatttgggctttagaaaaacagcgtgtcacccgttttatttattccttgatgactctttttttgtttgtttttgttgtggtcgttgttgttgagacagggtctcactctgccacccaggctggactgcactggtgcaatctctgttcactgaaacctcctcctcctgggttcttgcaaatagacagtcccatttggtggtgacgggagacagtgacagatcatcaagcattagattctcataaagagcgtgcaacccagatccctcgcatgcacagttcacaatagggttcacgctcctaggagaatctaatgctgctgctgatctgacaggaggcgcagctcagatggtcatgcaagcaatgaggagtgactgtaaatacagatgaagcttccatcgctcgcccgcccctcgtccactgctgtgcagcctggttcctaactggctggtttgaaactagactgggcaacatggccaaaccccgtctgctcaaaaaataccaaaattagctgagtgtggatcacaagtgtgtgcctgtagtcccagctacttgggaggctgaggtgggaagattgagtgagcccaagaggtagaagctgcagtgagctatgatcacacccactgcactccagcctgggttacagaatgagattctgtctctcaactccctgaggggtgggggacccctggtttaatccatccaaccctctcttcccatgaaataaaggaagttgtgagtgctattttgtgcgtcatcccctccagtattcaagtcagcccaaggtacttcgatggttcccgtctgcacatggggaaaccgaggcacagaaagcagactcatgtgaccaggaagtagctgtgtctgctcgaaactcaggtcgacctgataccataagtccttgcactccacgtgctggctattgaagctgtggctcgcaggtctgatgggagagcctcagacagtgtctcactctgtcacccaggctggagtgctgtcatgcagtcataacccactgcagctttgacctcctgggctaattgatcctcccacctcagcctcccgaatagctgggactacaggtgtgcaccacaatgcccacctaatttttgtattatctgtagagatgggcgtggggggtgtgaggggtcttgccatgttgcccaggctggtcttgaactcctgacctcaggtgatcctccagcttcagcctcccaaagtatcgggattacaggcatgagagagccactgcaggaagccaagagagcagatttggacaatgtagaatttctccacgctcctcctactgtccccatcttaggcctggctactgcgggactgacaggcatggctggctgtccatccgttccttagtttgattgcatggcagacatgaggaaggaaggtgagaactgagctagaaagttggcatttggtgctctggtttctcaatgcaagaaagtaacactttggcttttatagaataaccttctgaggaaattaacaacccgggcgtttcagccccctgtgaacttgattggagcatggtcacaatttgtaacgaaatgtgcttgcatgcccagtgctaaagatttctctctgtctaccctctaggctgtggaaaggtctgttctaaccattagcttgtatctggagctcagatggtgccggacactccgtaggagctcagatctgttgatagaagccactagagaatgggacaagcaacaggaggtgttttgctgcctagtaaactttttttgagatgaagtttcacttttgttgcccaagctggagtgcagtggtgccttctcggctcaccgcaacctctgcctcctggcttcaagcgattctcctgcctcagcctcccaagcagctgggatgacaggcacccgccaccatgcccggctaattttttttgtatatttagtagaaatgaggttttgccatgttggccaggctggtctcgagttcctgacctcaagtgctctgcccgcctcggcctcccaaagtgctgggattacaggcgtgagccactgcgcccggctctacccatctttcttacatgatgatgttcagcagccagcctgataggggagcattgtttgtcctttttttccttattgcattttccccgcataggtgccagggctcagtagcataaatccaggtagaactgggaagttccaggtatctgggctgtttgctctggtggacaaagagcagctgcaaggtgggtcttgattagccagtgaagtctgaggatccagagggaaacttattcctttcttttgttgaaatcaacatgagcaggaaatggatctttcccccaatcagagaacttcacatgtttttctaatagaatagcagtgtctgaggtatatacacggggagtggccccccgggaaaacgaggccatgaggctcctggcatggagatgacacacgaagactctcgtaacttatagaggggaaaataaagcagtcattccaggctgggcatggtggctcacgtctgtaatcccagcactttgggaggccgaggcaggtggatcacctgaggtcaggagttcgagaccagcctggccaacatggtgaaaccccaactctactaaaaataaaaaattaaaaaaaaaaattagttgggcatggtgctgggcacctgtaatcccagctactcaggaggctgaggcaggagaattgcttgaacccgggaggcagagattgcagtgagccgggagcctgtaatcccagctactcaggaggctgaggcaggagaattgcttgaacccgggaggcagagattgcagtgagccgggagcctgtaatcccagctactcaggaggctgaggcaggagaattccttgaacctgggaggcagagattgcagtgagccaagatcacaccactgcactccagcctgggtgacaagagtgaaactccatctgaaataaaataaaatataaaagttaaagcagtcatcctggcttttaggaacccgcagaatcaggaggtaagctaaaagtcgtctcccttttgtcacgatggaatgtgaaataggtgcattttccttctgacttatgattctgtttcacggtgcctctgcagaaattcagtacgtccccatgggcacctgtgtccttcaggagttgaggaaattttctccattccttgtccctgtccctagactctgccagctcgtgcatgtagaagctcccgggaaaactgtcaacctgtgcacattcaagaccgccatatacttgttattgaaaagccatcagtcatgtgagcagaacttttttatggttgagattgtccccagggaaacccgccttgcaattcagaccttccacggagatcgattccaaactctcatcccgttcccacttcctcgttcccatggaggctgcggttctctctctctgtgccgcttacagattgtcatacctatttccaaaaatgacacagaaaacttcaacgtgtggctaaatttgaacagagaaaaataagcaaagaattcaaggcgcgaggcgttttcagggagagagggagagcttttgcatggtttgaagggatgatctttaatgagttgagggtcacctagaatagaattaaactgtagagagcaaattgttggaaatgcaaggagaaacttcggagaagactccaacacagcctggatctgggagatgagactcaggtaacaaaaagtttgaataacatggttaataagattgtggtaacagataggactgaactttgcactctgcaaacaatatacattttaaagtgctcttggaatagttagaaaaatcaatcatctgttaaatctgaaaaaaaaaaaaaaaaaacaacaaaaccccaccccaaaccaatacattccaaaaaagcagacattgtacgggttctaatctctggctgcaagtaagcataactggaattaatttttaaaagcttaactgaacaagcatgtaagagagactcctaccacttgataattaaaaagaaaatgaaaaccaaaaaaacaaaaacaaaaaaaccgaaaagggctgggcaccatggctcacgcctgtaatcccagcactttgggaggccgaggcgagcggatcacctgaggtcaggagttcgagaccagcctggccaacatggtgaaaccccgtctctactaaaagtacaaaaattagctgagggtggtggcgcataccctgtaatcctagctacttgggaggctgaggcaggagaaccgcttgaaccccgggggcagaggttgcagtgagccgagatggtgccattggactcttctagcctgggcaacaagagctaacctccatctcaaaaaaacaaaaaacacaaaacaaaacaaaaaaacaaccaacccctaagtcttaagttggaggatcgaaacactgcaaggatagactatttgaagatgacaatgatgtgaacatggagacaaaggcagaggtttaaatgattatagaggaaatttgcttgataatttattatatgaatatagagagaaatcacaaaaatgagatgatgaatattggaaataataagcacagacgaactgattagaaaacaaatagaactgacaaaatcaaaaagctggatcttttagagagatgctgctcagtagggtggccacaacccacgtgaaaattaaattaaaaattcattttctcagtcgcacgagccaagtttccactgcttaggggccatgtatggttagtgactactgaaatggatagaacagatacagaacttttccatagctgctgaacgtttgttggacagtgctgttttagagggaggaatcaataaaacagaaaaactaagacaaaggagggggagagaacaaatattgtagataaaattaagaatgaaggcctagcgcggtggctcacgcctgtaatcccaacactttgggaggccgaggcgggtggatcacgaggtcaggagatcgaaaccatcctggttaacacggtgaaaccccgtctctactaaaaatacaaaaaattagctaggcgtggtggccgcgcctgtagtcccagctacttgggaggctgaggcaggggaatggcgtgaacccgggagggggagcttgccgtgagccgagatcgcgccactgcactccagcctgggcgacagagtgagactccaactcaaaaaaaaaaaaagaatgaaaatagatgtaatttatttattattgattgattgattgagacagagtctcacttggtcgcccaggctggagtgcagtggtacaatctcagctcactgtaacctctgcctccagggttcaagcgattctcctgcctcagcctcccgagtagctgggattacaggcgcccaccaccacacccagctaatttttgtatttttagtagagaagtgatttcaccctgttggccaggctggtcttgaactcctgacttcaggtgatacacccgcctcggcctcccaaagtgctgggattaaaaacagatgtcatttaaatccataaaaaattgtaaagacagctctactaacaattttggaaatattaaaaataacttcatttactgattcaagtgttacttttatttagcttaattgtttctctttaccagaaattgaggctctgaatttgccccagagaatgggtatgccattctctctcataagctgtactctcttattatcagtaatttctaaatagcctgtaaaatttatatggactcaaaatgcaggaaacatcaataggttgaaactcaacaacttgtaaaaagttactcctgtacttaattgcataaaatgtgtattgcctacatgaatgagaataaaaacttccaaaatgcccccaacaaacaggggtttttgcaccttgccatgagtagctttctggagcaagccggagtggttagagctgtgactcggcaaccacaaacacaaccatttttgtgtggaagtgtggctcttcagccttttttttttttttttttttttgagataaggtctcactctgttacccaggctggagtgcagtggcgtgatcctagctcactgcagcctcaacttcctggactcgagcaatccttctgcctcagcttcccaagtagctggaactacaatcatgtgtcatcatgcccagctaagttttattttttttaatctttaatttttttaagaaatagagatgaggtcttgctatgttgcccaggctggtcttgaactcctaggctcaagcaatcctcctgcctcagcctccccattagctggaactacacttgtgtatcatcatgcccagctaatttttaattttttatttattatttttttaaagagataaggtcttgctctgttgcccaggctggtcttgaactcctaggctccagcaatcctcccacctcagcctccaaagtgcagcctctatatcttgaactccacacctcaaacccagattgtccacatgtgagcacctgtctttttggtttgctgtttctctcgtgagttgtatccagttgcccaaggtggaaagttgggcgtcatccagcaggtaagtcctgacacctccacctccccgatggcttcagaagccagcctcttcttttctgtttcctctgcctctcaacttcctcatccatctaccataagccagaaaaatgacccccaaatgtgaatccgatggtgttctttctgcctgacatctttctttggcttctgctgtggggtaaagtccaagccccttggttccctgtctttcctctctggtctaatcttctattcctctcatcctgtactttgcccttcatcaactctgaactgtttatagttctctgaacatagcccgagtgattcacacatttgcatgtactgttcctctcctgctgtgataaagggacagtcacctaatccccgcccctccgttgcattttttttttcctacaagatttattatgcacctactgtgtgtatggctctgggatgctgtaataagcaagacagacacatctttcccttcacggggcgtatgtgtctcgtgcatactgggagggcagggacagggtctccattcatttctgcattccaatgccaagagggtgtcagatctgggtgggtcgaggtagggaacaggtaaacataactcacagtgtgatgccgtgttacagccaggctgggttcctcacgcctgtgatggcagcgctttggggagccaaagtgggaggattgcttgaagccaggagtttgagaccagcctaggcaacatagagagacccgctctcaaaaaaaaaaaaaaaaaaaaaagctgtcgcagtggcactctcctgtagtcctagctccttgggaggctgaagcggaaggatcacttgagcccaggagtcctagactgcagtgagctatgatggctccattgcactccagcctgggccacagagtaagaccctgtttcaaacaaacaaacaaatttaaaaaatcaaacaaactcccactcccccaaactccataccacaccctctcctggtctctctgggagacctggattcgagttctggcagagctggttattggcaaagtagcccctctatgcctcggtttctccaattctaatggtgatgattgcttgaataattgagttaatatgacctcattgatggattggaccgtgtgtgctgcaaacagattacacactttaaagtgtattcatgcctgtaatcccaacactttggtagactgaggcaagaggatcacttgaggccaggagttctaaaccagcctgggcaacgagtccccatgtctacaaaaaaatagaaaaaattagccaggcatagtgatgcacgcctgtagtcccagctactcgggaggctgaggtgggaggatggcttgagcccaggagtttgaggctgcagtgggcgatgatcacaccactgcactccagcctgaggcgacagagtgagaccccccccccaaaaaaagtgtatttatgggggtgaatgttaaatgagaatgtccactcgctgccttggtttactggaactgcaaattcaatggggacacacaagttttcaaatgcatgcggaatactggctggaggttaccccaaaaacgtagcctgtggattttaagaatgtatttatgagtatggttctcgttttctgggtgagtggtgggtgagaatagagggtgcactggcccggcgagttcggagatgcggaccctccccccctgcaatgtgaggaattttgctgtgtgaccctagtgagccgctgcacctttctggacccctcccgagggaggcctggggtcagggggcccctcggcagtcccgggagctgccacgcggtgacccgatctcctcccgggcacacgcccagcgccgcgcgcagcctaagccaccccggtggatgcttgatgagcccttgcaagctcggtttctccttttccctagctttttccaaagttccatccgtggcagactcgacctgcggggtctgcagccacgaggggccctcccagggcgccctttcctctggccgggaccgcccggcggcggccactgcccgagcgccagtctggggagcggagcccggcgcacccggggggcggggccagcgcccctgcagcacgcccgcccattggctgagcgcgagggcggcgctgcggccgccgcaaccgccggggccggattccccggagcggagtgcgccccgggctttgtgctgcgctgaggcctccggctcgagggggcggagccttgagcgcctagggctccctccctcgcccccatgggcacacacgcagacacgggcacacacgcagacacacacacacgcccatcatggacacacacacacgctcgcccaccatggacacacacacactcccaccatggggacacacacacactcccaccatggggacacacacacacacacacacacacacacactctcactctggaaccgaccaatcctggggctgcacagacacacacgcgcacacactctctctcgttctctctctctctctctcgttctctctctctctcgctctctctcccactctggaaccgaccaatcctggggacacacacacacacacacacacactcccactctggaacctgccaatcacacacacacacacactcccactctggaacctgccaaacacacacacacactcccactctggaacctgccaaacacacacacacactcccactctggaacctgccaaacacacacacactcccactctggaatctgacacacacacacacacacacacccaaacacacacactcccactctggaacctgacacacacacacacacacacacacacacacccccactcccactctggaacctgccaatcctggggctgctctagcgaggagacccctgggaccccgcctccttccgggcctctgcgtgcgcagtatatctcctaagagatccgcagcatggagagggcccgcccccgtggacggactcactccctccccactcactcactcactcgcttactcactcactcactctctctccgaagagaagaagcctgcggctcccgaagcgggaaggccctctggtactctgttccctttctagcctctatatgcgccgtatgtctccaaagagctgcgcagttctattccaaaggcgtcatcgcgtgtggggcggtattgtcaggcaaggaaaaggggcgcttccccgcttcaaggacacgcgctcctgcggtcgtcgctgctgaccacgaagctgtcaaaagttcacctccttggctgcccccaacccctgcccctttgccattaaatcatttactagattccaactagaggaatttggctccggggactcgaacctctgaggtcagggtctggggccagtgtgggagagaaaggccttgaatggaaacaaaataaattactttaaggagtttataaaactcacacttatagggagagccgcggggccctgtggtcaatgtaccagcaggcccatgacgcaactgttccgtttggaaatttctggaaagcagtaatttttggaatcataaatcttgagtattttttttttaaactttggaaaggtttttaaactttttttttttaagttttttttaaacttcggaaagttttaagctttggaaagaatgtaacaaaatgttattaacatatgtggagctatcgaatcatttaatggtggtttctgtattttctgttttgttttttatcacataccttcttaattaagaaaaacccaaactaatttgaactttaaaagggaggcaaacaaaaaagtgtcagagtgactggatttttgtgcgcaagtcatttaacaatgcagcgctgcgtctcctatttctctggcttttaaccttgctttggacaaattggtcgctttttgttttgatgtcgtttcaagcttacggaaaaattgcaagattatatctagatcaatcaattgtttacgttttattctacttgttttattacctttctaatatatttatgcacacacattatatacatttttttcccctgaactatttgagagttagttgcaggcatgatacatactccttaattcttcagtggatatttcctaagaacaagaaagttctgaggccaggcgtggtggctcatgcctgtaatcccagcactttgggaagctgaggcgggcggatcacctgaggtcaggagttcgagaccagcctgaccaacttggagaagccccgtctctactaaaaatacaaaattagccaggcgtggtggcacatgcctgtaatcccagctactcgggaggctgaggcaggaggttcgcttgaacctgggaggcagaggttgcagtgagccgagatggtgccattgcactccagcctgggcaacaagagcgaaactccgtctcaaacaaaaaaaaaaaaaaaaagaaagaaaagaaagaaagttctcttacataatgatggtactggtgccgttgtcaaaatcaggaaattaacattgatacagtattttaatccaatgtcttctataatcttatctgttgtctcaatattgccctatatagattttttttcctaggcgaaggttccaatctaggatcacactttgcatttgaatgctgctgtctcttaagtccgcacaattcctcagttttctgtgtctttcccaacattggcttttatttatttatttatttatttatttttatttttttttgaggcggagtcttactctgtcacccaggctagagtgcagtggtgagatcttggctgactgcaacctctgtctcctgggttcaagtgattctcctgcctcagcccccaagtagccgggattacaggcatgcgccaccacacccagctaatttttgtgtttttagtagagaaagggtttcaccatgttggccaggctggtctcgaactcctgatctccagtgatcttcctgcctcagcctcccaaagtgctgggattacacgtgttagccaccacacctggccaacattggcagttttgaagagcacaggccagttattttatcgaatgacctcaagctagggttagtaatatatggaaagaaagctacacaaatattttgtctttttcattgcctcataatgggaagtacgtgttgttgccttgtcccactattgtgggcaatgttacttgaagtatttttaactagaatttttaagaagaaatacatttcccgtaaggctcagtacccaagacatgcatatacctgaatgaaaagtttcccacaacaagatttactcttgccattttctagtactgtgggattttttccttttcttttccccctgcaggaggggatgctgctgggggctgaggacaatgctaaacctggatgtctcgaggacaggggatggggtttttgtgtcatctatgttctgatgctttttcatttaatacgagaacaggtttcctatgatttggcacactgggacattcgacatgtgtttgttgaatgaaaaaaagaaaaaagagaaatgctaacaatttgttgaatagtccataaaagagcaaagctggcctggcgcggtggctcacacctgtaccagcactttaagaggccaaggcagacggaggtcacgtgtttgagaccagcctggccaacatggtgaaaccgcttctccactaaaaaaaaaaaaaaaaaaaaaatcagttggtgtggtggcgtgtgcctgtaatcccagctactcaggaggctgaggcaggagaatcgcttgaacccaggacatgggggttacagtgagccaagattgcaccactgcactccagcctgggtgacagaaagagattttgtctcaaaaaaaaaaaaaaaaaaaaaagcaaagctattattaaaacacactccacacttcacccctgagccccatattgattttgtaataaggcaaagataatttttttttctttttttgagatgaagtctcattctgtcgtccaggctggagtgcagtggcacgatcttggctgactgcaacgactgcctcctgggttcaagcaattctcctgcctcagcctcccaagtagctgggattataggtgcctaccaccacgcccagctaatttttgtattttgaatagagagtgtttcaccatgttggccaggctggtctcgaactcctgacctcaagtgatcttcctgcatcagcctcccaaagtgctgggattacaggcgtgagccaccatgcccagccaacaaagatgattttaagagaacctttgtaaaagctctcaccgatgcctgtcattattagaatatttgggagtagaatcatgtaactgatcaataacattgtttactgtctagcagaggcttttgaaaaatgtatttcctggctgggcattgtggcttacgcctatgcccagtttgggagctcggggagagcggatctcttgagcctaggagttcaagaccagcctgggcaatattgtgagacctcatctctaccaaatgtatatatacatatacaaaaattagccaagcatggtggtgtacgcctgtagtcccagctactcaggaggctgaggtaggaggagcacttgaacctgggaggcggaggttacggtgaaccaagatcatgccactgcactccagcctgggcgacagagtgagacactgtctctaaataaataaatgaaagaagaagctacttgaaaaaaatatgtatttccaaatatatgtcagttttgacaggatagtacacatacatagtaaaaaataaaaataaaatagggcacttttttgtgtccctttcagagggacatatgtcccatgtgtcctcccccctcctgcccctaatttttttgtttgtttttttatgagatggagtctcactctgtcgccaggctggagtgcagtagcgtgatctcagctcactgcaacttccgctccccaggttcaggtgattttcctgcctcagcctcccatgtagctgagactacaggtgcgcgacaccatgctcagctaatttttatatttttcgtggagacggagtctcaccatgttggtcaggatggtttggctctcctgacctcgtgatccgctcaccttagcctcccaggcttagcctccttagcctgctgggattacaggcatgagcagaagaatctcttgaacccgggaggcggaggttgcagtgagctgagatcgtgccactgcactccagcctgagggacaagagtgagactccatctggggaaaaaaaaaaaaagaaaaaaaagaaatactgcatcaaattgcacttgcctcttggtgcaagattcgttcctttgctttgaactgcctccctgaagcaaattggtgtttctgtgactccctctgtctagggaaggggtcctttagtggggacattgtctttcttggggagggtccaccagaggactctgacacagcggtctcctttctcctccgtcaacttagttagattttagtccctgatcttctcagcagtgtatagtgaaaaagccaccgcagctgaaagtttcaggaagatgatagttgcttctgtgtgctcacccaggagcttttgggaggtttagggagaactgggggaaaattgggaccagcagctcaatgtggctttgaaggggagacagcggatggacacagaacttgcatttttggagaggggaggtctgggtagatgttccctacatacacagcagcacttgtgtgcaggtgtgagggagtgacagcccccggacggtttggcattttcctgcaagtctgccatcttgtctggcagacatagcctgggctgctgactgtccctaccccaaaccagaatttgggcaggaacggacacttgggctcattacgtgtcaatgagggggatcaggtcaggggcacagggagaggaaagtcaaccccgtcctccactggggctgtttctcatcttgcatgacacgtggctttcataatgtcttcactttgcggtctctctcaccagaagaagctgctgttttgtggctagttcatctgtgtcatgccctttccccagcctgggctgcctgtgatttttttcttttcttttcttttcttttcttttcttttcttttcttttcttttcttttcttttcttccctccctcccttccttctttctctttcttttctttctcctttctttctttttctttcttttttcttttctttctctgtctttctttttctttctctttctctctctcttatctttcttctttctccctctttcttttcttttttctctttctgtattctttcttctttctctctttctttccttctttctttctccctcccttcctgcctctttctttctctttctttctccctcttctttctttctctctctctcccctccctccctccttccttccctccttctttctttttatctctctccttccttccttccttccctccttctttctgtctttctctttcttttctctctctcccttcctccttccttccctccttctttcactctctctttcttttctctctctcttctttttaaagatagggtcttgctttattgcccaggctggagtgcagtggtgcagtcacagctcactgcagcctcaaacccctgggctgtagcaatcctcccacctcagtctcccgagtagctgggactattggtttacgggtgtgcaccatcacacctggctaatttttttatttttgtagagacaggggtctggctattttgcccaggctagtcttgaactactggactcaagagatcctcccgtgttagcctcccaaagtgccattacatgcacaagccactgcgcctggcaggcttgtgattttcatgtggagcttttcacattctgtctaacaatccgagttcagaggaaccagtatggggagcaagagtatgtggaaacgtccagcaccagtttagaggactcccactcagctagggggtgcagtggccaccccgagtggcttttctttcttttctttccctccttccctccctccctccctcctttctttctttctttctttctttttctttctttctttctcttttcttttctttctttttgagacagagtctcactctctcttccagcagtggcacaatctcggctcactgcaacccccgcctcccgggttcaagcaattctgctgtctcagcctcccaagtagctgggattacaggcacctgccaccacgcctgtataatttttgtatttttagtagagatggggtttcaccatgtcggccaggctggtctcgaactcctgacctcaggtgatccacctgccacggcctcccaaagtgctgggattacaggcgtgagccaccgttcccagcctctatttttttaaaattgacaaataataattgtatatgttacatatttatggggtaccatgtgatgttttgatatctgtttacattgtagaattactaagtcatgccaatttaaaagctatcacctcacatacttatcattgttttatggttaaaaatatctacatttttggcaattttgaaatgtccagtgcactattacttattatagcaaccattgtgtccaatacataactaaagcttatttctcctaagtgaaattttgtagtttgatcaacatctccctacagagttggaaacacctggaatgagcttatagtgttcgaaggatagtcttcaaagaattggttgggcgcggtggctcacgcctgtaatcccagcactttgggaggccaagatgggtggatcccgaggtcaggagttcaagaccagcctggccaacgtggtgaaaccccatctctactaaaaatacaaaaattagctgggcgtgatgacgggcgcctgtaatcccagctactcaggaggctgaggcagagaattgcttgaacccgggaggcggaggttgcagtgagctgagttctcaccattgcacttcagcctggacaacagagtgagactctgtctcaaaaaaaaaaaaaaaaaaaaaccaccaaagaacacaggtcagcatgtttatttaacccattagtgagggaacagcaggattataaagccaaaacatgtatagtcactgaaataagaaggcagtgttagctgtgaggctgcttaatgtcccataggacaataaaactgtaatctttggggatgatttttttcttttttttttcggcaaggagagataggatctcactctgttacccaggctggtctcgaatgcctgggctcaagcaatcctcccgcctcagcctcccaaagtgctgggattacaggcatgagcctccatgcccagctgagagtatcttttctctgagatgaaaataatttgtagcatatctgtctgtaagttaactctaatttccttgagtctagttcctaatagaaatagtaaaatcggccaggcgtagtgggtcatgcctataatcccagcactttgggaggccaaggtgggcagatcacttgaggtcaggagttcaagaccagactggccaacatgctgaaacccagtctctactaaaaatacaaaaattatccaggcatggttgtgggtgcctgtaatcccagctactcaggaggctgaggcaggagaattgcttgaacctgggacacagagtttacagtgagcggagatggcaccgctgtacttcagcctggacaacagagcaagactcggtttcaaaaaaaaaaaaaaaaagtaatagtaaaatcaattacaggtacatttaactagtgcaggttgataaactatctggcccatcacttgcttttataaataaagttttattggacctagccatgcctcttcatgtacatatgtctgtggctgctatcatgccatcgtggcagagttgagtagtttcaaccaacaccatatgtcctgcaaagcctcaagtatttgcttgtggccctttacagaaaaagttgaccaactcctgtgctgacaaatgaaatagctcagataggcctgtcagctagggctccaacacaggattgcaaagtctcgcagcctctggccttgtttgcaatggttggataatttttcttcccattgtctaggccggaaggacttatgtgtttgagaggtttgtgttaggccattgatgacgcctcttttgaatgaaagggctgaccctctgaagtggctccagcccaggaaacaagccccttcctcttgtgtgtgtgtttccttgccagagtgctggaactccgtgggtcctggatcattgttgtctgccttgtatattgcttccttcaattgaatttcagccctcaggttcccacagacagatcagtgttaatgatgttgataattatgataattatagataccctctgtagttaatttctatcaagcctaaaaatgtctctatcaaagaatctgatgtgttactgacgtcatcctgtttatttcttgcaacagccttaagaaggaaggaagggactcttattaacaatcccccctccctttttttttttttttttttttttgagatagagtctcgctctgtcacctaggctggagttcagtggcacaatcttgactcactgcaaactcctcttgcgttcaagcgattctactgcctcagcctcccgagtagctgggattataggcaagcaccaccacacccgactaatttttgtatttttagtagagacgggtttcaccatgttggtcaggctggtcgtcttgaactcctgacctcaagtggtccacccacctcagcctctcaaagtgctgggattacaagcatcagccactgtgcttagccctattagaacttcctaatattcttgttttttttttttttttggacggagtctcactctgtcagccagcctggagtgcagtggatctcagctcactgcaacctccacctcccaggttcaagtgattcttgtgcctcagccttctgagtagctgagtagctgggattacaggcgcccaccaccacgcccagctaatttctgtatttttagtagagtcggggttttaccatgttggccaggctggtcttgaactcctgacctcaaataatccacccacctcagcctcccaaagtgctgggattataggtgtgagcccccgcgcccagccccaagataattttcaagagtgatccatgccataaggaaaatgtaatgagataatgtgttagcttatgaatggagcaggaagggcgacttctgctggggaagtcagggaagatctgtgtaaggacctgaaggatgcaaaggagcaagtcacaaggggacaagggaccagggtgctccacccagaacagcttgtgcaaggtcctaaggtagggctgagcctgggtgtgtgtgggtgggaggtgcagaaaggaggccagcctgggagaagaatttagcaagactggcagggattagaccccccaaggcctgtagggagttggcttttattctgtatgcctgaactgtctcgtctgggagacggtagtcatctgtggctagtaaacattggaattgtgtcaggcacagtggctcatacttgtaatctcagcactttgggaggctgaggtgggaggatcgcttgagccaggagttcgagaccagcctgggcaacatagtgagaccccatttctacaaaaaattaaacacttagctgggcgtggtggcgcatgtccattattccagctacccaagaggccgaggtgggaggatcacctgagcccaggagattgaggctgcagtgaactgtcactgtgtcactgtaccccagaacctaagtgacagagccagaccccatcacacacccaaaaaagaaatcgttacacattttatccatatgacaaaatatcacaagtaccccataaatgtgtaaaatattctgtatcaatgtaaaactttttaaaaattttaaactgaaattaaaatgaaatgcagttaaaagttttgttccttggtaaaaattggagccctggtacactgttggtgggaatgtaaaatactgcagctaggctgggcacagtggctcacacctgtaattccagtactttggggggccagggtgagtggatcacttgaggtcaggagttcgagaccagcctggccaacacggtgaaaccccgtctctactaaaaatacaaaaaaattagcggggtgtggtggtgggcacctgtaatcccagctactcgaggctgaggcaggagaattccttgaacccaggaggtggaggttgcagtgagccgagatcgagtcactgcactccagcctgagtgacagagtgagactccatctcaaaataaattttttaaaaaagaataaatcctatattattccacttatatgaggttcctagagtcatcagagtcacagagacagaaagtaaaatgggatgtcgggcgcagtggctcacacctgtaatccctgcactttgggaggctgaggcaggaggatcacgaggttaggagttcaagaccagcccggccaacatggtgaaaccccatctctactaaaaatacaaaaattagctgggtgtggtggtgggcgtctgtaatcccagctactctggaggctgaggcaggagaatcacttgaacccgggaggcagaggttacagtgagctgagatcgcgccactgcaccccagcctgggcaacaaagcaagactccatctcaaaaaataaaaataaaaaaaaagaaaagaaaaagaaagtaaaatggcaggtgccaggagttggggaggaggatgagtgtgactgtttcatgggggcagagtttcagtttggttaaggtgagaaagttctggagatgggtggtggtgatggttgcatagccacataaaagtatttaataccactgaactatacatttaaacatgattacaatggtgaattttatgctatgtgtattttaccacaattaaaaaaaaaattggatttcctagttgcactaagcacattcagaagccacaggggagaagtggctactatgttggatggcccagatagagaacatttccgtcatcgcagaaatttcgaccagatggtgctgttcatatatggatgtagcttctggggccacttctgttccctgagtttggccggtgggatccactgtgctgagaatcacagtctggggatttggggtgaagaacactccccaactttctttcttattttttgttttgtttcattttttgttttgagacagagtctccctctgtcaccaaggctggagtgcagtggcatgatctcggctccctgcaacctcccctcccaggttcaagcgattctcctgcctcagcctcctgagtagctgggattacagacgcccaccaccacacccggctaattgtttgtatcatcagtagagatggggtttcaccatgttggccaggctggtctgaaactcctgacctcaggtgatccgcccaccttggcctcccaaagtgctaggattacaggcatgagccaccacaaccagccttttttttttccttccttccttccttttctctctctctttgtctctctctctcttttttttttttttttttgacagaattttgcacttgttgcccaggctggagtatagtggcacgatcatggctcactgcagcctccacctcccagattcaagtgattctcgtgcctcagcctcctgagcagctgggattacaggcatgcaccagcacacctagctaatttttgtatttttagtagagacagggtttcaccatgttgaccaggctggtctcaaactcctgacctcaggtgatccacccgcctcgacctcccaaattgctaggattacaggcgtgagccaccacaccgagccacatttgcatgtttaagtaactaacatgtctcctccattagaccttgtgctcccaaaggcaggatctgcagccacttttttccccacagtggccacagtatctagattagtgcaagcaaatgtctgttgaagcaatcagtggtttgggggcaagttacttaacctccctgtacctcagtttccccatttgtaaaacaaaaaaataaaggagctaacagtgtatctacttcacatgtggggtgcagcagcatgctggagttggcttgctggagccagtggtgaaattttcaggcaatttgtgagccatttgttaaacatagatattcataaaaattacataaacctacagttaaacaaattacattaaaaacaaaagtttttaaattaacaaagctttttaaaagtaacaaatactcaaaactcaccacctcctaatatcatacgatgttttcctattatttgtgctgttgaggttatttactacttttgtgtcaatagtagatacattttgtgtatacttataaatactacttagaggaatgctactgtgtatcttttgtcagcttatgtttagtaacttcatgttggtggcctgaaatccaccactggtaggaatatttacaccatggaaatcggcaaatgctatataaatctgggcctccctgggcccctccctcaggcagctgttaaacatttacaagctcaccaatggtttggaggcttaaaccagttaatagatgtgtctgacatgtgggtaatgatgtagacgtgccgcttttactgttagtgtttggttggctttcactgtctgatccagaattgctgcatatgcagacaggaattggacaaagccatttatttatttatttatttatttatttatttatttatttatttccctctctctctctctctctctccagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccagtacgtcattcacaacaacaagtgcatccctgagtgtccctccgggtacacgatgaattccagcaagtgagttctggatgtgggtctggggggcagccgagaggagaaggaacgtggggttggttgtgacgatgccgcttgttaaaactgtgtgcaaacccagggttaattggctatgagtgaggtctctgctctcagatgctacttttgcaccctgttttggtcctgggcttgggagtgggagttgactacctttttctctaaaggaccagatagtatatacttctggcattgtgcccaccattctttttttttttttttgagatggagtcttgccgcaagactcccaagctggagtgcagtggcacgaacctggctcactgcaacctctgcctcctgggttcaagcgattttcctgcctcagcctcccaagcagctgggactgcaggtgcctgccaccatgcccggctaatttttgtatttttaatagagacagggtttcgccatgttggtcaggctggtctcgaactcccaacctcaggtggtccacctgccttggcctctcaaagtgctgtgattgcaggtgtgagccaccgcacccagtctggcattgtggacctcagttctaagctttctgtggttggcttcagaacaagaaaatataataaggacagagtccttggttttccctaaaatcctccacgtggcctgtcctcactgatgtagcttcatcattgtcacataaaggatataccaaggtctttcgtgtcttccctgacctgtagcctggtggtgtgccaagattagcccagaacatactgtctccaggaggaagagactcgcttctgcattattctcagggctttgctgttctctgaaggacagtataatcaaaccatttcctgccgtttgggtgagaaatagcagggttttctctcttcgacagagtcagatttcctacgcacatcgcagactttctgttcgtactgtgagcttcttccatgagctattttggggccgtaactgagttgcaaaaatctgtttcctggtttttgtattgaggttttatgttttgttttaaaacacacacacacacacacacacacacacacacacaccacaaaacaacacaaaaacaaatcagaaacagacacacatcaagaggccttgagctgacctgcttacgtaaagtatcttcctcttcagacttgagaattagccaagcgagagtgttggggtgggaaattgtatttccctgggtggagagggcgggaaggaaaacaagctgtaatttcagttcttatgactctttctttgagtgtttgtgaaacctgcaagtacaatatgttttgttttgctcgttgttgataaaaacctaccaaaaaaaccttttggctttattgaccaaaagggtctataaatcaccttttcataccagacagacttttgttttaggtttttttttttttttttggccagtgtattcccaagattgaggaaatgaccatattccttttgattcatttctttctttttaaaatcacaattgaaataaaaaaaatgggttaatatcttctggcaagatgtttgtttaaaagacattggccttaaataaaaggcatttttccctcaccttaacaatggcctgagaaatatagcaacctcctttgattttctcactgatgatgcgggagatgctaaaacagaaaccctgagaaattgaccgcacatccttggtatctgggacctttcctgaacggaagaaaacaaaggagaggggggtgcattgtcaccgtattttattgcgtaggtttaaaaaaattaatatttttatttctgaagcttttaattaattaatttatttattttgagacagagcctcactctgtcacccaggctggagtgcagtggcatgatctcagctcactgcaacctctgccttccaggttcaagccattctcctgcctcagcctcccaagtagctgggattacaggtgtgaggcagcaagcctggccaatttttttttgtttgtgcttttgtttttttgagatggagtttcattcttgttgcccagactgaagtgcaatggtgcgatcttggctcactgcaactcagcctcccgggttcaagtgattctcctgccttagcctctaagtagctgggattacagacatctgtcaccatacccagctaaatttttcttgtatttttagtagagaccgggtttcatcatgttggccaggctggtcttgaactcctgacctcaagtgatccacccacctcggcctcccaaagtgctgggattacaggcatgagccaccgcacctggcctgaagcttttctttttatcttatgaaagacttaatcgtactgtggcattttctaatgtggtttgatatcaaatagggccagatgttttcttccattctggtggcttatctgggaaggagttcttgatgttttcagagcagagttctgggaacccatgttaaaaggccttggccaggcacagtggcttatgcctgtaatcccagcactttgggaggccgaagtggacggatcatctgagggcaggagttcaaggtcagcctggccaccacggtgaaaccccgtctttactaaaaatacaaaaacaaaaaaaaaattagctgggcatggtgatgcatacctgttatcccagctactcgggaggctgaggcatgagaattgcttgaacccaggaggcagaggttgcagtgagctgagatcacgccattgcacgttagcccccaggcaagtgtgacaagagtgaaactgcatctccaaaaaaaaaaaaaaaaaggtctcaccatctactgtcgttccaaagtacctgctgggatgtaatagcacagtgctgcttcctgagatgagaaggaccagatatttgtgatgaataaattttcaatgcgtatggggtatccactgggaaggggagaattacctaaaatccttgattcttcttggcctctctcacttcttcctattaagctgaggtctcaaatttgtctacacctccatctatttcaccatcatgtctggtctgacccagtccccttgaacaatctctttgctcctgcttccattctagtgacactggtaaaaagtggccacctgggccaggcgcggtggctcacgcctataaccccagcactttgggaggccgaggtgggtggatcacctgaggtcaggagttcgagaccagcctgaccaacatggtgaaaccccatctctactaaaaatacaaaaattagccaggcgtgggattacagtgggcgcctgtaatcccagctactcgggaggctgagacagcagaattgcttgaacccgggaggtggaggtcgcagtgagccgagagtgtgccactgcactgcagtctcggtgacagagtgagactctgtctcaaaagaaaaaataaaagtggtcatctgatcatatgccatgtccttccctaaaaccctccggtggcttcccaagaccaatggacagaatccaaactcctcatcgggagggctcggccagttctcattctcatttcattccggtgccccctggccgtggtggtcgttaccgcaggagcttttcctgcaacttgctacatccgctttcctctgtgcctttcaattagctgttccctcttcctataatgcttgtccctgcatttgagaatgatccactttttcccctcgtcatctagatggcagcttaaaagtcacctccttggcaaatccttcccgtctgagtcaatcatccgtgcactctctgtcacatcatttagttttaactcttcgatttgtcactagctgatatttttgtcttttttttttttttttgagacaaggtcttggtctgtcacccaggctagagtgcagtggcacccacatggctcactgtggtctcaaccccctgggctcaagagatcctcctgccacagcctcctgagtagctgggactatataggcacacaccaccacacctggctaaaaaaaaattctgtagtgttgggggtcttgctatattccccaggctcgtcttgaactcctgggtttaagtgatcctcccaccttggcttcccaaagtgctgagattacagggcctgagccactgtacctagcctttgttgtcaatttattcactctccccaaccagatgataagctttgtgagtgtatcagctagctcttgttgcgtaacaaaaccacctcagtgcttagtggcttaaaacactcctttaggagctctgatgatttcatgtgttgactgaaggtttgtctggcctgggcctgtttagctacggctgatggtttaggggagcctcttgtgtctttgatggtcagtgggggtctctctccataagtctcttaccccagcagccaggaagggcagacctcaatgttcaagtgcttttcaagcctcagcttgtatcacgtttgcaaatattccattggccaaagcaagccatatggccaagcccagattcaacaggtgggaacatagactccacttcttggtgggagaggctgcaaagaactcatggtcatttataatttcccactgggaaagcatattatctgctttgttcactcatgtataccggcagctgagaacgggggttggccaagggccagatagtaaatattttcagctctcagggccatatggtctctgttggagctacttaactctgcctttgcagcgtgaaagcagggttagacgatgtactaaccaataaatgtggccatattccaataggatattatttgcaaaaacaggtggcctactggatttggctcccagcccactgtttgccaactccaggcttagagcattgcctgccacataataagaatagaggcaataaaagaagtcaaacatttggtcagtattttgtttctgcctcagctgttctgccactacctgggtgtacttgcaacaccgttctgacaccatcctcctccaaagttagcatcagacgccacaagtttaaggctcagccctccatgagatttcccttgcttcagacactggcagcatcttggggatcccccagccacccacacttctgactaactggctctaaattgggggattcccacaaactgtttgggtttcataatttactagaaggaactcacagaatgaaaataaacctggccaggtgtggtggctcatgcctgtaatcccagcactttgggaggccatggtgggaggctcacttgagcccagaggttcgagaccagcctggacaacatagtgagatcccatctctacaaaaatttaaaaacattagccaggtgagggggtgcatgcctgtagtcccaggtacttgaggggcttaagcaggaggatcgcttgagcccaggagttcgaggctgcagtgagctaagattgtgccagtgcaccccagcccgggtggcagagcaagatcttgtctcaaatttaaaaaccctgctatacaattacagttttattataaaggatacacatacggcaagatctgggagagttctagatgcagaatttccatattgcctcctcgtggcaacagcatgtatcaccctcttgacatactggtgtgtccaccagctgggaagtactactgagcttcagcgtccagagtttttgtttgtttgtttgtttgttttgagacggagtctcactctgtcacccaggctggagtgcagtggctcaatctcagctcactgcaacctccacatcccaggttcaaacaattctcctgcctcagccccccgagtagctgggactacaggcatgcaccatcacgcacggctaatttttgtatttttagtagagacagggtttcaccatgttggccaggctggtctcaaactcctgacttcgtgattcacctgcctcagcctcccaaagtgctaggattacaggcgtgaggcactgcacccggcccagtatccagagttttaattggagtctcattccttaggcgtgattgattgaaatcattgaccatgtgattcaacactgccatttccagccccctcatctccctggaggtcctaaaagccccaaccctctgatcacagggttgttctttctggtgaccgccccccaccctcatgttatctaggcacccccccccccacaagtcaccccgacattcctaacactcctaacaaaagcattcctgtgactcagaaagttccaagggtttttgaagctctgtgccaagaaccgggatgaagaccagatacatactttatgatcctacagtcacaaaaatcactctgaagagttgaatacccaggagtgtgagaacaacagcagcagcaacaaggatgccaccaataaaaaatgacccttgtagcaacggataaaattgcgttctgtgtgcgaagtgcttttgtggtatgcttcattgagttcctcatcacaagctgtggcgttggtggtgttattttcagatgaagaaatggagactgtaacagttgggaatcttgtggtttcatgcaccagaaccccaactcaaattggcttaactggccgggcacggttgctcacacctgtaatcccagcactttgggaggccgaggcgggtggatcacctgaggttgggagttcgagaccagcctgaccaaaatggagaaaccctgtttctactaaaaaaaaaaaaaaaaaaaaaaaatacaaaattagatggggcatggtggtgcatgcctgtaatcccagctactcgggaggctgaggcaggagaatcacttgaacctgggaggcggagcttgcagtgagccgagatcgtgccattgtactccagcctgggcaacaagagtgagactccatcttaaaaaaaacaaaaacaaaaacaaaacaaaaaaaccattgacttaaccaagattaaaggagtttgttggtacccataaccaaaaagttcagggagttggttcaggtatagctgtatcaagaagcttaagcgatgtacctgatcagtctccttcatctttattttcctctttgttggttttgttatcaggcagcttctccctcacccttcaccccatgctagcaagatggcaaaacccttagatactccagaaggaagacaatttccccttccagcatgttctagcaaaaccctcactgcactgacttaagttctgtacccaccacctctgagcccccacaggaatagaaggtggtgctcagcttggcttggatcttgtgcccatcctggatctagaagggctttggcaaccaagaactgatctcagagaccccgtgttggggaggactggttcccaaaggactcctgggggctgtgagtttgatggcatcaggctgcaggctggcaaaaccaaaggctgcccaagtcacttgccattaaacatggggtcatgttacagccgtagttgcatcacatcccacacagaacagcaaatgtcctgtctccttggagtagcaggttgaattctgccacgttggggtaactgtcagttctgccacatcaggcccatcatctcaaggtaacggcacattcttattaccacatgcattagtccatttctgcactgctataaagaatacatggaactgggtaatttataaagaaaagaggtttaattggctgacagttctgcaggctgtacgggaagcatagcagcttctgcttctggggagacctcaggaaacttacaatcgtggcggaaagcaaaggggaggtaggcacatcttacatgactgaaggaagagagaaagggggaaggtgctacatagttttgtttgtttgttttgagacagattctcactctgtcacccaggctgggctgcagtggcacaatctcggctcactgcagcctccacctcctgagttcaagcaattctcatgcctcagcctccccagtagctgggattacaggtgggcaccaccacacctggttaatttttgtatttttagtagagacggggtttcaccatgttggccaggctggtctcgaactcctggcctgaagtgatccgctcgccttggcctcccaaagtgccggaattacaggcatgagccaccatgcccggctggtgctacatacttttaaacaaccagatctcgtgagaactcactcactatacactgccaaggggtatggtgccagaccattcatgagaactccgcccaccatgatccagtcatctcccaccaggccccacctcccacattggggattacaatttgacatgagatttgggtggggacacagatccaaaacatatcgccacgataatgctatgagtcccattgctgtcacgcacagggtagatcatggtcctgcctccatgggatatggtgtgaatcccatcactgtggggtccagcaggagtcctgtcccatcactttggggtaaaatatgagtcttgtcactttggggtaaaagcaagaggacctgcaaccatagggtaatggcataattctctcacttaaggcagtggttcttttctggggacaatctggcatcctccctccccaggggacttttggcaatgttgggagactttttttttttttgagatggagtctgactgtgtctcccagctggagtgcagtggtgctatctcggctcactgcaacctctgcctcccaggttcaagcgattctcctacctcagcctcctgagtagctgagattataggcacgtgccaccacacccagctaatttttgtatttttagtagagacagggtttcaccatgttggccaggctggtcttgaactcctgacctcaggtgatctgcccgcctcggactcccaaagtgctgggattacaggcgtgagccactttgcctggcctggaggacatttttaattgccacaacttgtgggagggatgctactggcagctcgtgagtggagcctagggatgccgctcaatatcctccaatgcataggacgccacccccactaccacagtggagaattacttggccccaaatgtgaacaatgctgaggtcagaagaccttgccgtagcatgatggacttatgccatcacttgagaccctgcatagtgtgctgtcttcccaggctgatcttgaactcccaggctcaagcaaccctccctccttggcctctcaaagtgcaggaatgacaggcaggagccaccacgcccggctccagaatctacatttttaacaatcaagcgatatgtcctattgcagatcggcagactgtgttttcagaaatatcatctcaggcagaaagggccgggtgcagtggctcacacctgtaatcccagcactttgggaggccgaggcgggtggatcacttgaggtcaggagtttgagaccagcctggccaacatggtaaaaccccgtctctactcaaaaatacaaaaattagccaggcacggtggcgggcacctataatcccagctactgtggaggctgaggcaggagaatctcttgaacccagaaggcagaggttgcagtgagctgagatcgcaccactgcactccagcctgggcaacagagcgagactctgtcacacaaacacacacacacacacaaagaaataccatatcaggcagaaagatgcctgagatgtctgaaggaccttggataccgtgacacccccctcccctttctctttctctctctctctgctccgtccttagcttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcagtgagtgtctctgtgtgggcgtcgggggtgcctgttgggctccatgtccctctgagctgtgagcggggaagaaaagcagtgcagaccctgctgcgtgctcctacagcacttttaggatggtcgttcagtggctcccccatggatagaaccatgctgggagtctgcctcaaaacctgaaatgaacagctcagtcttggccttactaaccttgagattctcattttctactttgggagttggggcatcaggaatctgcatttacatttatttttatttttatttttatttttagagatggggtcttgctccattgcccaggctggagtacagtggggcaactctagctcactgtagcctcaaactcttgggctcatgcagtcctcctacctcagcctcccaagtagctgggagtacaggcaggtgtcactgtgccgggctaattttttttttttttaatttttttccagggccaggttctcactatgttgcccaggctggtctcaaactcctgggctcgagcaatcttcctgcctcagcctctcaaagtgcagggattacaggcatgagccaccccacctggctttggaatcgtcgtttttaacaatcaagcaatatgccctattgcagaactgcaggctgtgttttcagaaataaatctcagggccgggtgcagtggctcatgcctgtaatcccaacagtttgggaggccgaggcaggtggatcacgtgaggtgagaagtttaagaccagcctggccaacatggtgaaaccctgtctctactaaaaatacaaaaaaattagccaggcttggtggtgcgtgcctgtaatcccagctacgcaggaggctgaggcaggagaatcgtttgaactcaggaagtggaggttgcaatgagctgggatcgcgccactgcactctagcctgggcgacagagtgagactccatctcaaaaaaaaaaaaaaaaaaaaaaaaagccaggcgctgtggctcatgcctgtaatcccagcactttgggaggctgaggtgggcggatcacttgaggtcagaagtttgagaccagccaacatggtgaaaccttgtctctcctaaaaatacaaaaattagctgggcacggtggcacatgcctgtagtcctagctacttgggaggctgaggcaggagaatcacttgaacctgggaggcagaggttgcagtgagccgagatcacaccactgcactccagcctgggccatagaccaagactccatttcaaaaaaaaagaaaagaaataccatgtcaggcaaaaaggcattcctttgtttatttctttagcgaacatgtactgaatactcacagtgagtaagggaaagtccttaccttgatggatttttgcgcataagtaaatcgacagatattgtaaggtcaggttgtggtctgtgctgtgaagggaagtgcagcagggtaataggtggaatggaaatgggcaacttttccctataaagggctctttcatgaatatattcagcctggcaggccgggcagtctctgccgtaaccactcaactctgccgttgtaatatgaaaacagccatagacccatgtcagctagcaggcatggctttgttccaataaaactttatttacaaaacaggtagaatttggccagtgggctgtcatttgtcaacctctaaaatggagactaacaggggttgctatttttttttttttttgtagttttagtagagacagggtttcaccatgttggccagggtggtcttgaactcctgacctcaagtgatccacctgcctcgccctcccaaggtgctggtattacaggcatgagccaccagcaccaagctgggggttgctattttagagaagtctctggtatgggaaaggagggtttgagatgatgatggaacaagccaaggagatatatggtggaataatattctgagcaacagacgcagccagtgccaaggtcctggggcagaagtatgcttgacccatttaaggaatgctaaggacttcagattgtgttctaagcatgatgagttttgagctgggtatgtccagtcatttgcagcctgagggttatcttctcaccatggagaatcatgagaagattgaaatatgtctatagaaacccactggatattctctcctttccttagacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggtacgtgggcctgattgtgtgtatggcctgagtgctaactaggaagttcgtgtattagaacaacttaaggatttttttggccaggtgtggtggctgatgcctgtaatcccagcattttaggaggccaacgtgggtgaatcacttgaggcggggagttcaagaccagcctggccaacatggtgaaaccctgtctctactaaaagtacaaaaattagccaagtgtgatagtgcatgcctgtaatcccagctacttgggaggctgaggcaggagaatagcttgaacctgggaggcagaggttgcagtgagccaagatcacactactgcactccagcctgggtgacagagtgagactctgtccaaaaaaaaaaaaagaaaagaaaaggaaaaacttaaggattttttaaaaatcaaataaaaacaaataaaaaacaaataaaagtatatctggcaaaacctcgggaaaaaagaacttggaatgtgcctaaaggtccatccagccaaaaattgtaaaagcttttttatagtcattcttgagaaacaaaagtgggagcagcccaaccttggtgcccatcctccaagggtacaggctggaatttttgctaaatttgctgtttgggctgcattgtgagtagagtttggcatgcataaaatgaacattccctcttagtcccggttgtccatcctaatttctgggatggactccatctcagtatattccagtatattccaaccttctccttgaggtcctagaaactctattagcaaaacagcagaaactcaaactagctagatcaagattgactcataggcaggaggtctgtggaagacccagattctttccatctttgtgctcctcatggtcacaagatggctgcctcagccccagcctcacatctgtagaacagacagcaaatggggaaagggacaaaaggacatgttaatcaacatgagctggtaagtgacttgagaaggtggtctaaacaatatagtttagactatattatctgtactccagcctaggcaccagagtgagaatccatctcaataaaacaaacaaacaaacaaacaaaaaccttcaatggctcctttctccttattaaggatggccacatgttcttggtcttggtctggcatgcaatatactagagggtctggtccattgcaactacagctatttcctgtcacctattggccaaaacaggctactttgctcttccctgaactcagcttaggtgcctctgtgttatcagtatttcccctatttgcagaaattggtttctgcaaaacctattcctcagtccatcacagactcaccacccctcttcaagactgagctgagcctccttcctggccatgaaaacttcctcaacttcctctgttatccacattcaacaaatatgtgttgagtatgtgccaagcaagtggagaggattaggcacgtagcactgaacaagatcaactccgagcatggccacaccatcttggagttgtagaagaccagccgttgaatgactagatgtgtgtgttttttccataggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtaagtcactggtccccaacctttttggcatgagggaccggtgtagtggaagatggtttttccatggactggtggtgggtggggatggtttcagcatgattcaagtgcattacatttactatgcactttattcctattatgattacattgtaatatataatgaaagaattgtacaactcaccatcatgtagaatcaatgggaaccctgagcttgtgttcctgcaactagatggtcccagctgggggtgatgggagacagtgacagatcatcaggcattagattttcataaggagtgtgcagtctaggtacctcatgtacacagttcacaatagggttcacacccctgtgagaatctaatgccgccgctaatctgacaggaggcagaactcaggtggtcatgcaagcgatggggagtgactgtaaatacagatgaagcttcacttgctcacctatcactcacctcctgctgtacagccctgttcgtaacaggccatggataagtactggtctgtggcccaggggctggggacccctgctgtaagtggtccacaaaccagataatgtggctgtcctctctcatccatcacagtcacccccagggggtattacttccctctaacaactcactgtgtgataggctttcttactgagggcagattctgcacatttattaatattatcactatgcttactgtgccatatagtaccggatacgggatgaagtcatacaagcactgaatgaatggatgaatgaatgatggatgaatggatgacaccttcttatatgtgtatcaggctgatgctgaagacttcaaagttgagtaaaatacctatgtcagtctgcatctcctgggaagtgactgccaagttgaagttaggagtgcagaaaatgtattgagggtaatattcataaaatatgaaacagaggaagagcttcttttttttttttttttttttttgggacagagtcttgctctgtcacccagggctggagtgcagtggcgtgatcttgcctcactgcaacctccttcccctgggttcaggtaattatctcgcctcagcctccagaatagctgggattacaggcacatgccaccaagcccggctaatttttttttttgtatttttagtagagacagggttttgccatgttggccagggtggtcttgaactcctgacctcaggtgatcctcccgcctcggcctcccaaagtgctgagattacaggtgtgagtcaccacgctcagccatgaagagccttttgacaatagcgtgtgtctgacctctgtgaacagagagcgggaaggagggaggatagggctgggagagtctcagatggtgatgcatccctgagtcttggccaaacccagaaagagatcaaggccacggttgtctgcagggaagttctgcattgcaaagggacggccaggcatctaccaagctcagtcataggtgggggctgtccagggagagtcaggttttggctggaatgctacagcaggtcctgcagtttctgcagctgcaggctgcctgctgactgcacttccctgacagattctaaacagtgagctgccaagggcttctgggataccttcatggggagttagttacttatgtcaaaatgtagtgcaagggctgggcatggtggctcacgcctggaatcccagcactctgggaggccgaggcaggcagatcacttgaggtcaggagttcgagaccagcctggccaatgtggtgaaactccatctctactaaaaaaaaaaaatacaaaaactagctggacgtggtggtgggtgcctgtaatcccagctacttgagaggctgaggcatgagaattgcttaaacccggtaggtggactgcactccagccttggtgacagagcaagactgtctcaaaaaaaatgtagtgcaaggagagagagcgaggttggggtgaggtttaggagagggtttgtcttctaggcagagagaattacttagatgcgtctctccgatgtctaatgatctgcagggtctctaaactcacttggcataggtttatttgcactggagttgcacctccttccaggtcagtcttacaagtccatatgcgagacaacgttgtgtcaggacaaacatcacccttggaaatcccttcctccaataactattggccggttgtccttcttgcgcgggtacagactgcgcttattcagttgactgtctggctgagtcaagtcattggcttacgtgagtgtgagtggccaagttgcaaaactggctcttacctttgaatcttcccccattcatactcagccaggcacatggggaggagacccttaagggaatagcagcgtcacctctgccttctcacggtccctccaggaagtgtgggggtcccaggctttggtctgaaactacactgaaatagctcatttttgccttttgttttaacttttccaggtgaaaatgagttacttaaattttcttacattcggacatcttttgacaagatcttgctgagatgggagccgtactggccccccgacttccgagacctcttggggttcatgctgttctacaaagaggcgtaagtagaagagttagagagacgctgaggaggcgagggctggctggctctgtgcttgctacgtttgtgctccaatctgcccctcttgggttcctgtctatctccctcctcctcctggaataaatatcttaggttcctttttacaatctcaccagtcgatggcatgcaaagtcaatagtgtctgcttttatcaaatgcctaaaatggaagcagacagctttcccatagaagcccggactggccagtttcctggggcaatattctattttgccttgcctgtgtatgtctcatcagacatccttagtagtcaggagctcagtctactaagtggatgttatcaaatgtattgcttatctatttttcttttttatccccaattttttttttttttttgagacagagtcttgctctgttgcccagggtacagtgcagtggcagatcttggctcactgcaacctctgcctcccgggttcaagcagttctcctgcctcagtctcttgagtagctgagattatgggcatacaccatcacacgtagctaatttgtgtatttttgatagagacgggttttgccatgttggccaggctggtctcaaactcctgacctcaggtgatctgcccaccttggcctcccaaagtgctgggattacaggcatgagccaccgcacctgaccagtagtaatattaataatagttctagccctcaagatttaccttgtgccttgctgagcactgacacacagtctaatcttatcagtaacttgtgagggagctcctgctattactattattacagattgagtatccctaatctgaaaatctgaaatttataatgctccaaaatccaaagctttttgtgggccgacttgatactcaaaggagatgcttattggagcatttcagatttcagatttttagattagagatgctgaaccagtacaatgcaaattaactagtaaaatgcaaatatttcaaaaccccaaaatatccaaaatccaaaacacttctggtcccaagcatttatttatttatttatttatttatgtttttgaaacagagtctccctttgtcgcccaggctggagtgcagtggtgcgatctcagctgatgctacctctgcctcccgggttcaagcaattctcctgcctcaacctcctgaatagctgggattacaagcatctgccaccatgcccagataatttttgtatttttagtagagacggggtttcaccatgttggccaggctggtctcgaactcctgacttctggtgatccgccattctcggcctcccaaagtgctgggattacaggcgtgagccactgcacttggccaagtctcaagtgttttgaataagggatgcccaagctgtgttttttcattgagatgtcagggttgacagttcctttctctttggctgttcccgagttattttttcttgtggcattagattgttgggtgagtaacatgtgaccctatgggatgtaacttcccaggcctcatctgcacggcactcagtgtgacggtcttgtaagggtaactgccttctgctgttttgtcttgaaagcccttatcagaatgtgacggagttcgacgggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccagtgagtgtgtcttgggaatgtgaattcgtatgtgaatcagacctcttgcttttaataggctgatgcagtgaggttgtataaaatgctccttgatatggttattggctttttttttttttttagacagggtcttactttgtcacccaggctagagtgcaatgcagtggggtgatcatggctcactgcagcctcaaactcctgggctcaagcaatccttctgcctcagcctcctaagtagaaggaactaccagagtataccaccatgtgtggcttttttttttttttttctttgagatgaagtctcactctgtcacccggactggagtgcaatggcatgatctcggctcactgcaacctccgcctcccaggttcaagtaattctcccacctcagcctcctgagtagctgggactacaggcatgcaccactatacccagctaatttttgtatttcttgtagagacagaacgttgctgtgttacccaggctggtcttgaacccctggcctcaagtgatcctcctgcctcggcctcccaaagtcctgggattagaagtgtgagccaccttgcccagtcagttattggcttttaaaggagctgggtattgaggcttatagtttcagacgaggcagtagcaacaagccacttgatgggaatatttatatttttcatcctattatgaaaaattgtcaaatattcacaacacagaacaaaaccccatagttagccgcctcccagcttcagcctttggtcatttttgtttcatctcgacgcctgttccctcttcccacttgttacttctttttgttttgttgtttgttttggcctggagtatttcacagcaatttaattatgtttgtttgtttgagatggagtctcactctgtcacccaggctggagtgcagtggcgccatctggactcactgcaacctccacctcccaggttcaagtgattctcctgcctcagcctcccaagttgctgggattacagcacacttggctaatttttgttttgttttgttttgttttttgagacagagtctcactctgtcactgaggctggagtgcagtggtgtgatctcagctcactgtaacctccccgtcccagttcaagtgattctcctgcctcagtctcccaagtagctgcaactacaggcgtgccaccacgcccagctaatttttgtatttttagtagagatgggatttcaccatgttggccaggatggtctcaatctcttgacctgcaatctgcccaccttggcctcccaaagtgctgggattacaggcataagccaccatgccagccttttttttttttttttttttttttgagatggagtttcgctcttgttgcctaggctggagtgcaatggccctatctcagctcactgcaacctctgcctcccgggttcaagcgattctcctgcctcagcctcccgagtaactgggattacatgcatgcaccaccacgattggcgaattttttttttttttttttttttgtagagacaaggtttctccatgttggtcaggctggtctcgaactccgagcctcaggtgatccgcctgcctcggcttcccaaagtgctgggattacaggcatgagccaccgcgcccagccatttttgtatttttaatagagatggggcttcaccatgttggccaggctgctctggaactcctgacctcaaatgatccgcccaccttggcctcccaaagtgctgggattacaggcatgagccactgggcccggcctaattatatttttgtaaaacctaagtgcttctcttatagcagtagttcccaaaggaggttaactgctctgccagggaacagctgccaatcaatgtctggagacatttttggttgttacagctgtggagatgaaaccactggcatttcgtgggcggaagccagagaggctgttccatgtcctgcaacacacaggatgcaccctccttcatgacaaagaattatccagtcctaaaagccaatagtactaagggtgagaaaccccgtcctgtaggctcaaattcaagcttttttttttttttttttttttttaacggagtttcactcttgtctctcaggctggagttcaatggcgcattctcagctcactgcaacctctgcccaggttcaagattctcctgcctcagcctcccaggaagctgagattacaggcgcccaccaccatgtccagctaattttttttttttttttttttttttagtagagatagggtttcaccatgttggccaggtgtagtctcgaactcctgatctcaggtgattcagatgattcgcccacctcggccttctaaagtgctgggattacaggcatgagccactgtgcctggcctcgaattcaaactttataaatcaaccctatcttcttcagttaatccccgctcattcatcctgtatcttttagtgacaccaaaagacttacagttttcagaaacttctagctcccaggtgtttggactccctccccatccccagctccctcggccacctccgttactttgggttttttgggttttgtttggttggttggtggtggttttttttttcttttttgttttgttttgttttgagacggactcttgctctgtcacccaggctggagtgcagtggcgcaatctcggctcactgcaagctccgcctcccaggttcacgccattctcctgcctcagcctcccaagtagctgggactacaggcgcccaccaccacacctggctaattttttgtatttttagtagagacggggtttcactgtgttaaccaggatggtctcgatctcctgacctcgtgatccgcctgccttggccgcccaaaatgctgggatgggtgccctcatgatgtctttaacttgtgtgtcccccgccatcctcccaccagctttctttgcacactgtttctcatgatggacccatttcctttctccctgacagacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaaggtgagtgcaggcagctgtgctaggatcggtggggtttgcacacgtgtgtctgatgcactttgcttcacctctagggaagcagctatctcttcctgtgtctcagtgtcggaaggcacacacacacacactccattctatctcatatgaaaacacacatacatgtttttatctatttatttatttattttattttttatttatttacttttttgagatggagtttcactcttgttgcccaggctggagtgcaatgacgcgaccttggctcatcgcaacctccacctctcgggttcaagtgattctcctgcatcagcctcccgagtagctgggattacaggcacgcgccaccacgcccggctaatttggtatttttagtagggacggggtttctccatgttggtcagcctggtctcaaactcccgacctcaggtgacctcaggtgatccacccaccttggcctcccaaagtgctgggattacaggcatgagccaccacacccggcctattttttttttttttttgagacagggtcttactctgttgcccaggctggagtgcagtggcatgatctctgctcactgcaacctccacctcccaggctcaagcaatcctcttgcctcagcctcatgagttgctggaacaccacaattgtctgcaggtgtgcaccagcatgcccaggtaatttttttttttttttttttttttgagacagggtctcactctgtcacccaggctggagtgcagtggcatgatctcggctcattgcaacttctgcctcccaggcgcaagcgattctcctgcctcaggctcctgagtagctgggactacaggcgcctgccaccacacccggctaatttttgtatttttagtagagatggggtttcaccatgttggccaggctggtcttgaactcctgacctcaaatgatccacccgcctcggcctcccaaagtgctgtgattacaggcatgagccaccacgcctggccctggctaatttttaaacttctttttgtagagatggagtctccttatattgcccaggctggtctcaaactcctggcttcaagcaattcacccccctcagcctcccaaagcgctgggattacaggcgtgagccactatgaccggctcatacatacacatttttaaacatcgtaacacaagcacgcactgaagacttgtgtcaaaaccagatttttcccatgtcttggcaccatttccctctgggattttctcctcttgtctctccttctttctccctccctgccttccttgttctcttcatccctcctcacactgatggggatgcagctgtgttaacccacgcaagacttctgtgcaaagctagaaacacaactaatggttattgacaaagtcagggaaggattttggccccactgagatcctttagttgtaaggatcgaaggcagcaagaattggttatctcatatcccccaccccatactttcaattaaaaatgtctgccaggcttggcgctcatgcctgtaatcccagcacattgggaggccaaggtgggaggatcactggaggccgggagtttgagaccagcctgggcaacatagcaagatcccatctctaaaaaaatttaaaaaaatggtggtgtacacctgtagtcccagttacttgggaggcccaggcgggaggatctcttgagcccaggagttcaagtctgcagtgagctatgattattccagtgcactccagcctgggtgacagagcgagaccctgtctctatatatataaaaaaaattatacaaaattaaaaaaaaaaggcattaagtgcattcacaatgttgtgcaatcattttattgtataaaaattataaataaaatttataaataattatataaataattttattataaaacttaatgacaaatttttcttaatcttgtttacttaatagacctccatccatctgaaggaaaatggaataatatttaaagtctcaaactagtgtgtatacattagtttaaaattattattattattattttctttttttttttttttgacacggagtctcactccgtcacccaggctggagtgcagtggcttgatcttggctcactgcaacctccgcctgctgggttcaagcgattcttgtgccttagcctcctgaatagctgggattacaggtgctgccactacaccggctaatttttgtatttttagtagagacggggtttcaccatgttggccagggtggtcttgaattcctgacctcaaatgatccacccgtctcagcctcccaaagtgctgggattacaggcgtgagccaccgcgcccagcctaaaattattttaacattgggtttttttagaacccaccaaactggagaagcatctgtcacttttttctttttctttttcttcttcttttttaagatggggtctcactctgttgtccaggctggagtgcagtggcacaatcatagctcactgcaggcttgaactcctgggctcaaacgatcttcccgcctcagcctcctgagtagctggactacacaggactacaggcctgagacactatacctggctaattatttaaaataattttttaggccgggcacagtggctcatgcctgtaatcccagcactttgggaggccgaggcgggtggatcaccaggggtcaggagtttgagaccaccctggccaatatggcaaaaccccgtctctactcaaaatacaaaaattagccaggcgtgggcctgtaatcccagctactcaggaggctgaggcagaagaatcgcttgaacccgggaggtggaggttgcaatgagccgagcttgcaccattgcactccagcctgggtaacaaaagcaaaactccatctaagaaaaataataataataaaaataataataattttttagaggtggggatcttgatatgttgcccagggtggtctcgaactcctgaccacaagcgatcctcctgcctcagcctcccaaagtgctggtattacagacctgagccactgcgctgggcccatttccttctttagttttggtttccttgtgcatcttgatgtatttttcttgagatattttctgttagtgatatcctcggtccatgaccctggaggagaaggccagggggccactggcgaggtgtggctgaggccaggagctcaacatttgctcttggctctggccctgacctgctgaagggctttggctaagttcccaagcaagtcaccgtctgcctcctttttgggagaaggggcgggaggacagatgatctctgggagctgtcccagctctaagctcatatgctatatgtatgtgtgtgacatcatccccgcctgagccgagggttgcaaacgtgatttatctgctctgatgctttatataactccagggcgagtccagtcatcagctccgctgtaagctgttggccctgcattcaagtaaccagaaccacccgtgagagctgccaccagtaatgtcactcgaagcttccttttttttttttttaattccgaaagtctaaatctgtaattaccaagggaccatttaaacatggttttatttgtaattgtcacaaagttaatatcattaaaaggaaactcactaaggacaaattctgtgtgatttcactcctaggaggtccctagagtcctcagattcatagagacagaaagtagaatggggagtgccagggactgcggaggggacgggttgaggacagagtttcagtttgggaagatgagaaagttccggagatgatggtggtgatgattgcacaacattgtgaatgcacttaataccacagaactgcacacttaaaatggttgagatttaccgggcacagtggctcacgcctgtaatcccagcacactgggaggccgaggtggggtggatcactttgaggccaggagttcgagaccagcctgggcaacatggtgaaaccccgtctctactaaaaatacaaaaattagttgggtgtggtggtgggtgcctgtaatcccagctactcaggaggctgaggcaggagaatcgcttgaatctgggaggcagaggttgcagtgagccgagatcacgccattgcactccagcctggcaacagagcaagactccaccaaaaacaaaacaaaacaaaaattgagatggtaaattggtatattttatgtgatgcttatttttccacaatttcaaacacacacacacacaaataaataagcttacaaacccttcctgttaatatcactagtgtatatgttgttaccacggtaaaatatacatcacatacaatttattattataaccatgtttaagagcacagttgagctgcattaagtgcattgccgtggttgtgcggccattaccaccatcatctccagaactttctcatcttctcaaactgaaactctgtccccatgaaacactcactccccttctccttcccccagccccagcacccaccatcctcctttctgtctctgtgaatctgattctagagacttcattatgctcatttttcttttcttttctttttatttttttgagacggagtctcgctctgtcacccaggctggagttcagtggcgtgatctcggctcactgcaagctccgcctcccgggttcacgccattctcctgcgtcagcctcccgagtagctgggactacaggcgcccgccaccacgcccggctaattttttgtattttttagtagagacggggtttcaccatgttagccaggatggtctcgatctcctgacctcgtgatctgcccaccttggcctcccaacgtgctgggattacaggcgtgagtcaccgcgcctggcccattatgcttcatttttctaatctcaggaaaaccacagtgtaccatgtttcatgcagtggattctaggaagaggtagcaggtatcaggaatgatacctgtgcctgaacaaatatcccttcctctccaaataataataataataataataataataataataataataataataccaggagcttcccttattcaggcagttctacatttttttttccatctgtaatgctgtaactagctcccatcagagttaacccaggcagggtattctatgtctatttataaacttaagaagtattttccagtctctcataggcttttaaagctgtgtaaatacttgggtttccgagtggatactcaccattcacaggaaggtacttgatacacgatttagagcttattgtctatcctcgaggcattaaggggaggagagaaaatggaatttcctttgctcagcagtcaccaggcaccaagcagagtggcagcaggggaggtggctctccagggactgttgcagattttgcttgtaaagagctgtgtccgtccatctcagtggctgtaccagaggcataactgtgcttgcaccgtgggtcacaagaaccctgggatttgacttcggggcttaagacatgaccagctgcggtacttaagtattgtaggctgggtgcgatggctcatgcctgtaatcccagcactttgggaggccaaggcgggcagatcgttcgagctcaggagtttgagatcagcctggccaacacagcaaaactctgtctctaccaaaaaaaaaaaaaaaaaatacaaaaatcggctgggcgcagtggctcacgcctgtaatcccagcactttgggaggccaaggcgggtggatcacctgaggtcgggagatcaagaccagcctggccaacatggcaaaaccccgtctctaataaaaatacaaaaaaaatgccaggcgcagtggctcaagcctataatcccagcactttgggaggctgaggcgggtggaccacctgaggtcaggagttcagaccagcctggccaacatggccaaaccccgtctctactaaaaatacaaaattagccgggcatggtggtgcacgcctgtagtcccagctacttgggaggctgaggcaggagaatggcgtgaacccgggaggcagagcttgcagtgagccgagatagcgccactgcagtccggcctgggcaacaagagcgagactccatcccaaaaaaacaaaaacaaaaaacaaacaaacaaacaaaaaattagccaggtgtgatggtgcatgcctgtaatcccagttacggggagtggagctgagacaggagaatcgcttgaacccaggaggcagaggttgcagtgagccaagattgcgccactgcactgcagcctgggcgacagagcaagaccccatctcaaaaaaaaaaaaaaaaaaaaaaaagagagaaatagtattgtattttgtatttttaggactgctacctttataagctactggtgttcttcttcatttattaatttttaaattcccttttctatgcatgtttgaaaagttccttcctctatctcctctcatgcctttaggtcagggtttctctgtcttggtgttttttctgtctggcgttggatcattctctggggtgggactgtcccgagcacttcagggtgctcagcagcatctctggtcttcacccattccatgctccaggaggacgccccagccaggtcctgacacctaaaaatatctccagatgttgcccaatgtccctagtaggagacaaaatcaccccctgggtgagaaccattcactgatcaagtctgatttctggactcatgaatggaccccttagaattccatgtggaggcccagtgtggtgacccaggcctgtaattccagcactttgggaggccgaggtgggcagatcacatgaggtcaggagttccagaccagcctggccaacatgatgaaactctgtctctgctaaaaatacaaaacattagccagggtggtggcaggcgcctgtaatcccagctacttgagaggctgaggcaggagactcacttgaatccaggaggcggaggctgcagtgagccaagatcacgccactgcactccagcctgggcgacagagcaagactgtctcaaaaaaaaaaaaaaaaaaaaaaaaaaaagaattccatatggcattctactctgccctcccatcttatttgtgtggttgattaattgattgattgatattttcatgcagctgtgacctggctccttctcctcctccttcttctccttcttctttctttttcttcttcttcaacatgatttcactctgttgcccaggctggagtgcagtggccccatctcagctcactgcagcctcgacttcccaggctcaagcaatcctcctacctcagcctcctgagtagctgggattacaggcgcacaccaccatgcctggctaatttttgtattttttggtagagacggagtttcatcttgttggccaggcttatcttgaactcctgggctcaagtgatccttccccctcagcctcccaaagttctggtattacaggcaagagccactgtacctggccccctttatctttttctaaccccctcccaccattctctctctcacccccttccagctatattggtttccagagatttttttttttttttttgagagatggaatgcttcctctgtcacccaggctggagtgcagtggcgcaatcttggctcaatgcaacctccgccttccaggttcaagtgattctcctgcctcagcctcccaagtagctgggactacaggcatgtgccaccacgtgcagctgatttttggattttttagtagagacagcgtttcactatatgttggccaggctggtctcgaactcctgacctcaagtgatcctcctgcctcggcttcccaaagtgctgggattacaggagagggccaccacgcctggccagacgttttttaatgtgccaagaaaattcctgtcctggggcctttctgctgggtttctgctatgtctgaattgctttacaccacgatatgtggatggtgctttcctttgctgaattcaggatgtctcagtggtgactttctttgagaccccttcatgaaaatggcacccgcagacacccactgttcttttaccccaacatctgacctgtgactgtgtatttatgagtttattgtagactgtaagtccactgaagacagaagcattgtctggttaccttataatcttcagtcctgtgattatggtgtcgggcagttgttgcctttttttgagacagagtctcgctgttgtcgcctaggctggagtgcaatggctcaatctcggctcactgcaacctctgcttcccgggttcaaacaatcctcctgcctcagcctcctgagtagctgggattacaggcacccaccaccacgcccggctaacttttgtattttgagtagagacggggtttcgccatgttggctaggatggtccggacctcctgacctcaggtgatctgcccgcctcggcctcccaaagtgctgggattacaggagtgagccaccgcgcccagccacctggcagtttctattaggttggtgcaaaagtaattgtgggccgggtgcagtggctcacgcctgtaatcccagcactttgggaggccaaggcgggcagatcacgaggtcaggagatcgagaccatcctggctaacacaatgaaaccccatctctactaaaaatacaacaaattagccgggcgtggcagcggccgcctgtagtcccagctactcaggaggctgaggcaggagaatgccatgaacccaagcggtggagcttgcagtgagccaagatcgcgccactgcactccagcctgggtaacagaacgagactccatctcaaaaaaaaaaaaaaaaaaaagtaattgtggttttttgccattacttttaatagcaaaagctgcaattacttatgcactaaactaataaaacatgttgacatgcacttctcagatgacactctagatacagatattttatttatttatttattatttttttgagacggagtctcgctctgtcacccaggctggagtgcagtggtgccatctcagctcactgcaacctccacctcccaggttcaagcgattctcctgcctcgacctcctgagtagctgggattacaggcatgcgccactacacctggctaatttttgtatttttagtaaagacggggtttcaccatgttggccaggctggtctcgaactcctgacctcaggtggtctgcctacctcagcctcccaaagtgctgggattacaggtgtgagctgcctggcctatttttattggttattttactttatttttagtagagacagggtttcaccacattgcccaggctggtcttgaactcctgggctcacgtgatcctcacacctcggcctccgaaagtgccaggattaagggtgtgagccactgtgctcggctatatttttaatcttttgagacagggttctactctgtcacccaggctgaagtgtaggggtgcaatcatagctcactgcagcctcgaactcctgggctcaagcgatcctctcacctgagcctcccaagtagctgggaccacaggcgtgaaccatagtgtctggcttttttccaaagcggagctcaaatctaggctctgtctcagctcagcctctctgagaaggcccccttcactgtgtgtgtgtgtggtgcgtgtgtggtgtgtgtgtggtgtgtggcgtgggtgtggtggtgtgtgtgatttgtgtggtgtgtggtgtgtgtgaagtgtgtatgtggtgtgtgtgtggtgcgtgtatggtgtgtgtggggtgtgtggtgtgtggtctgtggtgtgtggcgtgggtgtgtgtggtgtgtgtgtgatttgtgtggtgtgtgtgcggtgtgtggtgtggtgtgtgaggtgtgcatgtagtgtgtgtgtggtgcgtgtatggtgtgtgtgtggtgcgtgtgtgtggtgtgtggtgtgtgtggtgtgtgtgtggttgtgtgtttgtggtgtgtgtatgtgtggtgtgttgtgtggtgtgtgtggtgtgtggtgtgtgtgtgtggttgtgtgtttgtggtgtgtgtatgtgtggtgtgttgtgtgatgtgtgtggtgtgtgtgtgtgggggggtgtgtggtgtgtgtgtgtgtggtgtgtgtgtgtggtgtgtgtgtgtgtggggtgtgtgtgtgtgtgtatgtgtgttcagccgcagagacttgagccccccttttctgtttctttctccagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccaggtcaggacttggcgctgggctctcttagtgggtgccaattggcttggtgttggtggaaggtcattacttagggaccgagaggtagtgggacccagagacggcagaagggtgggtggagtctgaatggagccctttcctgggtggaggaagagatcttgcagtttcgaaatttcgaggggaattttatcaggaagagcaaataatcgcacaaaaggggaaaaatggacaaaactcagcatttgcctttcttacctctcctgagctggtctccacgtgagttccaaaacaaactccgttagacgattaacatttttttttttctctctctctcttttttttttttttttgacagagtctcactctatcgtccaggctggagtgcggtggtgcgatttcagctcaccctttccgggttcgagtgattcttgtgcctcagcctcccaagtagctgggactacaggtgcgcagcaccacgcccagctaatttttatatttttagtagagacggggttttgccatgttggctaggctggtctctaacccctgacctcaggtgatctgcctgcctcggcctcccagagtgctgggattataggtgtgagccaccgtgcctggccgtgattattgaggctttagctgagcgcagtggtgtaagcctgtggtcccagctagttgggaagccgaggtggtagggttgcttgaggccagcctgggcaacataatgagaccccatcgctaccaaaaaaaaaaaaaaacagtttaaaaattagtcaggcatggtaatgcatgtctgaactcctagcccatggggaggctgagaaagaaggatcacaagaggccaggagatggaggctacgataagcgatgatggcgccactgcgctccagcctgggtgacagagtgagaccctgtctctaaaaaaaaattaaaagtatctgttcagatgtttaccaatgctattcatccgagcagacttttctcccagaaccaccagtgtgtaagaatcctcttttttttttttcttttctttttctttttttgttgcatgtttcccctatgaccctgagtccaaaagaatgttcagggggacagccaaggcttcaaagtggttactgtttcacctgttacaaacaaaatgttggctaggcacagtggctcactcgtgtaatcccagcactttgggaggccgaagtgggagaatcagttgaggccaaaggtggagaccagcctgagcaacagagtgagaccctatctctactaaaaaaggaaaaaaaaaaaaaaaatagccagacatgttggtgcatgccttgtagtcccagctactccggaggctgaggcgggagaattgctggagcacaggagttggaggctgctgtgagctatgatggcaccattgcactccagcctgggcaacagagcaagaccctgtctcaaaaaggaaggaagggaaaaaaagaaagaaagaaaggaatggagggagggagggaaagaggaaggaaggaagagagaaagaaaaagaaagaaagaaagaaagaaagaaagaaagaaagaaagaaagaaagagaaagaaagaaaggaaagagagaaagaaaggacagagaaaggaagggggcaagggagggagagaggagggaaggaaggaaggaaaaaaggaaaagaaagaaaagaaagagaaagaaaatgaaaaaaagaaggaaggaaagagaaagaaagcaaatgaaggaaggaaagagggaaaaagagagaaagaaagtaaaagaggaaagaaggaaggaaggagagagagggagagagaaaagagaaagagaaaagaaaaggagaaagaggaaagaaaccagaaagagagagagaaagaagaaagaagggaaagaaaagaaaaattctgccagacttggagaagtggctgagtcagttgtgatgtccacatgtagtcacgtttgacatcccagggccacctcagcaggccgtctctggggagaattttctctgatttcttccccttcccttgctggacccctgcacctgctggggaagatgtagctcactccgtctagcaagtgatgggagcgagtggtccagggtcaaagccagggtgcccttactcggacacatgtggcctccaagtgtcagagcccagtggtctgtctaatgaagttccctctgtcctcaaaggcgttggttttgtttccacagaaaaacctcttcaggcactggtgccgaggaccctaggtatgactcacctgtgcgacccctggtgcctgctccgcgcagggccggcggcgtgccaggcagatgcctcggagaacccaggggtttctgtggctttttgcatgcggcgggcagctgtgctggagagcagatgcttcaccaattcagaaatccaatgccttcactctgaaatgaaatctgggcatgaatgtggggagaaaccttcactaacacactcttgctaaaacatagaatcatgggagtgcttcctgggtaccccctccctgccttctgtttgcagccactgtttgctcactaaacatctctgcacctcccgcgtgcatttgcagaggtgggtgggggtccccggagtctgagctccccgcggctgggtgccccgacccagcagctcctacaccatgaatggaggttgatctggaaacagaatattttcatgaaagggcgacagggtatgaacaaaagaacaccgtgtcgctcactgaattccacggaggagagtcagggatctcttccttccttccttccttccttccttccttccttccttccttccttccttctttctttttttccttctttctttctttccttctttcttttcttttctttattccctccctctctccctccgtccgtccctccctcccttccttctttccttcttcttttttttttggatggaatttcactcttgttgcccaggctagagtgcagtggtgcgatctcggctctccacaacctccacctcccgggttcaagcaattctcctgcctcagcctcctgagtagctgggattacaggcatgcgccaccacgcccggctaatttttgtacttttagtagagacagggtttctccatgttggtcaggctggtctcgatctcccgacctcaggcgatccgcccgcctcggcctcccaaagtgctggaattacaggcgtgagccaccgcccctggccagggacgtttcttttcaacttgagtcttaagagaatgaagcagtatggtcctgggagagagaaaaagcttggagaacttgggagaaaggcaaggagatgtttacctgtcgtggcttttgggaggaacaggaggtgagactaaagaggcaagttgggaccacttggagagattttcttcctttagcagagtgtttatttatttattttttcccaggcacctgtgtggcctgatctgccctctagtggccatttgcaatactaactgtagccaagaagggtctaaaaatgtacgggcttggtccaaagcagatctcaatctcagtcctgctattaataatattcgggtggctcacgcctgtaatcccagcactttgggaggccgaggcgggcggatcatgagatcagaagatcgagaccatcctggctaacacggtgaaaccccgtcactactaaaaatacaagaaattagctgggcgtggtgacgcagctaccccaggcggggcaatcacttgaggccaggagttcgagaccagcctgaccaagatggtgaaaccccgttactacaagaaacataaaaattagccgggcgtggtgacacacgcctgtagtcccagctactcgggaggctgaggcaggagaatggcgtgaacctgggacgcggagcttgcagtgagccaagatcgtgccactgcactccagcctgggccacagagcgagactccgtctcaaaaaaaataaaaataaaataatatttggggccacagctggacttggtagctcacgcctgtaatcccaacactttgagaggcccaggcggggcaatcacttgaggccaggagttcgagaccagcctgaccaagatggtgaaaccccgttactacaagaaatataaaaattagccgggcatggtgacacacgcctgtagtcccagctacttgggaggccgaggcaggagaatcacttgatttctggaggcggaggttgcggtgagccgagatctcgccactgcattccagcctgggtgacagagcgagactctgtctcaaaaaaaaaaaaaaaaaagaataaatacataatactaataataataataaataatatttggggtcagattattctagggcactgtccaacaacactgagaagcatccctggcttccactcatctgatgccagtagtgtgtcttccccctaaagtagtaataaccaaaaatatcttcagacattgctaaatatccccctgggtgatggggtcagaaggacccttggttgagatgaccaggttagtgtgggattgctggataataaaatgctgcctaggccaggtgctgtggctcatgcctgatgcctgtaatcccagcactttgggaggcccaggcaggcagatcacctgaggtcaagagtttgaaaccagcctgggcaacatggcgaaaccccgtctctactaaaaatacaaaaattagccgggcatgatgatgcacgcctgtaatcccagctacttgggaggctgaggcaggagaatcgcttgaacccagaaattggaagttacagtgagccaagatcacaccactgcactccagcctgggcaacagagcaagactctgtctcaaaaaaaaaaatcagttgatgctttgtcttttgccacttcatggtctttttggttataatctttttggtatataaactcatttggcctgtttgatgagcccattttacatctctggttgttgagataccaatttctcagtagttactcatgaagcaccaacgtcttggttattttcacgagacccatttgtgcctgtatagaaattatctgaatcttgctaatacggacatatctttggcttgataagtggtggagctgttttcttttccattctacaatgttgttagtcttttaatacaaaaagaccataaagagaatcttaagaaatgcccccaaagtaggatttgttttctgaccacacattttctgatgacgctgcaatagaaactaaaagttaatttcaaaagattaaacagaaaacttcacttcttggtggttaaaagttaaacacttacaggctgggcgcagtgactcacacctgtaatcgcagcactttgggaggcccaggcaggcggatcacctgaggtcaggagtttgagaccagcctggccaatatggtgaaaccccttctctactaaaaatacaaaaattagccagatgtggtaacgtgcgcctgtagtcccagctactcaggagactgaggcagaagaatcacttgaacctgggaggtggaggttgcagtgagccgagatcacgccactgccctccagcctgggcaacagagcgagactctgtctaaaaaaaaaaaaagttaaaaagttaaacacttacatatctatcgggccaaagcagaaatggaaacttccattgaagtccttttggaaaataatgaaaatgtgaatatcacataccttaacttgtagaatattgtcaaagcttggctttgatgttacttagcagacttaaatggattgataaattaagaaataaactttaaactataaaactataaatgtgttaggaagggaaaagcaataacagctaagcctatggtaaacataatcaaagggaaaacacaaaccagaaggaaagaagatgacataaaactagcgtctgaagaaaattttaatgtgttaagttctttggacaatggtgcacttgctaaatttgaaagtttcagtaaggtgggaaaatttaacttgtctaaatggattcaaaaagaagcagaaaaattaagtggttatgaaccttggaaaaagatatgtgtcaaataatttcctcaaaaaagtcccttggcccagagagttttatagacacgttctttcaaattgtgagagagcaactatttcctataatagaaaaactattttagggcacagaaatctataaaagttatcccagttcattttatgaaatgaacataacacccttaaagaacttgacaaagaggttgagcatggtggctcatgcctgtaatcccagtactttgggaggctgaggtggggggcggatcacaaggtcaagagattgagaacattctggtcaacatggtgaaacactgtctctactaacaatacaaaaattagccagacatggtggcacacgcctgtaatcccagctacttgggaggctgagccaggagaatcgcttgaacctgggaggcagaggttgcagtgaaccgaggttgcgccattgcacactccagcctggcaacagagcaaaactctgtctcaaaaaaaaaaaaaaaaaaaaaagaacttgacaaagatactgcactgaacaaaagccacaggccaagctaatatgtgatgttagattcaaatgtcccaaataaaacactgcactggcaatattgtttatctccaaaatgcaaggatggtttaagatcagaagatttgataacatcatctagttcatcaagaggtgcaataaggaagatcatatctgtttcaataaccttaatttaaaattcctaacttagagaaaggggaggaaaaaaagaggcttcataaaactcataatagaatatttcttctacaagataaatattacctaggttaaaccaacagccaagctaacatcattcttaaaattattcttagcagagttaggaacaaaacaaggaagccccatctcatcattactaattaacatttctctgggcatccagccaatgtaataagacaagaaacagaaatcagagttgtaaagaatggaatgtgggaaataaagtcattgctatttgcagagcgtctagctcaagggtaggcaaactatggcccatgggctagctgcctgtttttgtaaatgaactcttattggaatgcaaccccacccacttgtttacacatcatgtagggctgctttaagctacaatgacagagtagttgtgacagaggtcatttggcttgcaaaacccaaaatatttattatctagccctttacgggaaaattttgttgacccctcttctagtgtgtcattgaaaacccaggaaagccaattatgaaactttttaaatgagttagagtttgggaaagtaggtacatagaaataagcaaaaagactgtagatacacaagcaataattagaatataaaataagggaaaagatccctttcaaaattgccgtaaaaccttagcacaactcataataaccccatctagaatgacttataaaggaacacgttttaaagtgttactgatatattaaattgtacaaataaacatgaaagcctgtttcaaatcatttaaagaaagcttactggcaaatggaaaagagtaagttgtatagcacgatacataaaaggttaatatccttaatgaataaacaacacaggagtaaggaaaacacaagaaattcatggaaaaacagacaaaagacaaggaggggacaattctttggagaatcacagagaaccaataaaggaaaaatgaagtcacactcagtaatataaagatccgcaaataacgtagtcgagtgatagcatatttttaatctcttgggttaaagatctagacaaacaaacatagaaagaaaaaaaaaaactattaaggcttaggggttgctgagattgtcctggaatgcagtctcatggcctgctggtgcaaccacaagtcaatatagagtttctggacaaccatttagctgtaggtattaagaagcttaaagagtttcttatctccctgaacctagtaatattttcctctaggaatctactttggggaagtaataagacaatcagacaatgatcaaaggaatatttataacagcaaaaaaaaaaaaaaagagccatgtgcggtggctcatgcctgtaatcctggcactttgggaggctgaggtgggcagatcacctgaggtcaggagtttgagaccagcctggccaacatggcgaaactccgtctctactaaaaatacaaaaattagctgggcatggtggcggactcctgtaatcccagctactcaggaggctgaggcaggagaatcgcatgaactcaggaggcggaggttgcagtgagccaagatcacgccgtcgcactccagcctgggcgacaagagtgaaactctgtctcaaaataaataaataaataaggaggatggttaagtgagtgacgactcacgtagcaaatggaatattttacagtcattcatcgttttccaagttttctgcagggaacacatgctacttttgtagatgatggaggaaaaccctaatattaaaaaggaaaagtcccaaaattctctcctaaaatgttatgttgaaaggaaaatatttagtaaatgcttccaatataataagtagacaaagtttacttataaaacaggcttgatcctcatcatgttcacacataatatttacagggaaaaaattgtccaaaggaagcagtgggctgtggatttatgagtgatttatattttcttttcttttttttttttttgagacagagtctcactctgtcgcccaggctggagtgcagtgacacgatctcagctcactgcaacctccgcctcccgggttcaagcaattctcttgcctcagcctcctgagtagctgggattaaagctgtgcaccatcaggctcggctaatttttgtatttttagtagagacggggtttccccatgttggccagactggtcttgaactcctaacctcaggttatctgcccgccttggcctcccaaagtactgggattataggcatgagccacctcgcccagcctacattttcttctttatccttttttctttgtattttaaaatttgttagctatcaacctttgttgtttaatatgtcttcttaagggatggggagaagtgtgccaattgcatagatgtttcttggagttaatcttcctgacctgagtgatgtgattccttttctaagaattgcagcttaatcactcaaattatacaggtgccctaagcagcaataagaaggaaaagatgtattttttcctatttaaactgatgatgtcgatcagtagcttgggccaatgagcaaatgccatttggcagggcttcctgaaaagctagactcttacgtgcttttggtgtcttatttttgtcactgaccctggctggcctatttatctgcaaaatgaaaaacctgaaatcgagcatgtcgaggggaatatcggtgtgtgtctaccattgacggtcttagaagcactcatccctcacgaggtgggcctgctctaatccttcagatgctcacaagggtatattgaaagctgctctgagtggtcattcctggcagtctgtattgtaatccatgttccccattgctgcaccctcctgcgctctgatctttcttcttaatcaagccttttattctccagtgtcacttttttaaaaaaaatgatggtgatggtgtcatcatacatgtcctactgtcgttccaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaaggtagggctgctgctccggggtccgagtgtcatgggtgggacatcaaggctgaccaaggacagattctccaccctctaagcagtgcatatctgtattttaccttattggccttcatttttgtttgagacggagccttgctctgtcgcccaggctggagtacagtggtgcgacctcagctcactccagcctctgccacctatgtcaagtgattccctgcttcagcctcccaagtagctgggactacaggtgtctgccaccacgcccagctaatttttgtatttttagtagagatggggtttcaccatattgcccaggctggtcttgaactcctgggctcaagtgatccacccacatcggcctctcaaagtgctgggattacaggcatgagcaccgaacctggccttttttttttttttttttttttttgagatgaagtcttgctctgtcgcccaggctggagtacaatggcgcaatcttggctcactgcaatctccgcctccctggttcaagcaattctcctgcctcagcctcctgagtagctgggactacatgcgtgtgccaccacacctgtattttcagtagagatggttccaccatgttgcccaggctggtctccaatgcctgagctcaagtggtccgccaaccttgagctcccaaagtgctgggattacaggcatgagccaccatgccaggtcatattttaaaattatgagtcataggcaatcattatgtaaactttagaaaatacaccactgcactcccgcctgggtgacagagcaagactctgtctcaaaaaaaaaaaaaagttatacgcagaaagtaacccatttaatcttcctaacaatcttgtgggatgagttttagatgtccgttctctgacgaggaaaatgggttgtgggaaaatgacgtcaccagcccaaggttgcaccatggacaggtggcagaagtgggatctcatccaagagttacatccctgcctctcacttcctctccttacagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggtaaggcccttgactcttgggcatgcccctgcacacttcagcatgccccttcagagttgcacttggtacctccttcctctgctgaaattttgattccagtgcttctctcatcaggtactgtgctattagtacttaaagccttgatacctgacttcgcaggaagatgggtcagaaatgccaatctaccagcttgttacttttcttagtttctcacattgctttccagctgtgtcctctaagttgaatgatgtctgcctcccaccacaacaggagactcatttcactttagaaggagttatttgagtcttaaaaccttataaattgctgggtacagtggctcacacctgtaatccaagcactttgggaggccgaggcaggcagatcacttgaggccaggagtttgagaccagcctggccaacatggtgaaaccccatctctacaaaaatacaaaaattagccaggcgtggtggtgggtgcctgtaatcccagctactcaggaggccaaggtgggaagctgaggcaggagaatcacttgaagccaggaggtggaggttgcagtgagcagagattgcaccattgcgctccagcctgggtgacagagtgagactctgtctcaaaaacagcaacaacaaaaaccttataagttactttcattagatgcttccattgagccagacaccatgcaaggtgctgggtgagtgcagagatgcacaagacatagaatccaagacaaataacccaaaagaacccaaacagttgctaagctcttcccagggctcactgtatgtcccaaacacattcagcacgttacacagagtatctcattgatcacattttattacctctaggaaattttgagaggccccattatttttatggacagctaggcaaaaaaaaaaaaagggccgttaattctaattttatttttttcgtagaatatagatcctgagtactgttaagtgtttgtaaaatgcattgcttgtaagatgcattccaatttcagaaatgccaaaatgcaaaaataatatacctcttgggactgaggaagtacaatacgtcctcacattatcccagtgagctgggtactgaggcttccagagtttaagttgctgcacaaaacctggaagaatagaatcatgatccaaatgcatgactgatatttcaatccagaaactgccaaattttttttaccataaaggtctggatagtaaacatgtttgactccgtggccagatgatttctgttacaactactcaattccaccattctactgagaaagctgccatgggtgatatgtaaatgaatggatgtggttgtgtaccaataaaactttatttacaaaaacacgtggtggaccaggtttagttggtgggccagagtttgccaacaactaacagagattacagcaaaatgtctgatttcctggaactttgagagggagtcctcctataaccaggtggacctccctctacccctcctgggaccacatctactcttggcaaccaaagattttggctttgacaataatttacaattgagatctaattctaaattattgtggcttgtgggccaaatctggcttgcagagcattgtaaagaatgtgcaacagggttgaggtcaggagttcaagaccagcctggccaacatggcgaaactccgtctctgctaaaaatacagaaattagctggacgtaatggtgggcgcctataatcccagctgctcctcgggatgctgaagcagggagaattgcttgaacccgggacgcaaaggttgcagtgagccaagatcgtgccactgcactccagcctgggcgacagaacaagactctgtctcaaaaaaaaaaaaaaaaaaaagaatacgcaacagagactatatgtggcccttcacagcttcacagaaaaagtaaactttcaaaaatagaaagtgtccttactgaacttgtcattctgggcctattttggggccctgtttgctaaatgaatggcttgatttgccttttttaacattcatttttaaaataaaattgctaaatgaatggcttgatttgccttttttaatattcatttttaaaataaaattccttatcatacagagctcagctagtttttaattggcagaaacgtgcatatgcctctaatccatattcatgagttactttcctctgccttttgatgtctctgtccacaatagcctttggaattatgatttgtagttgctagatagaatttaatctcatgattggggtatcatttatttttggggatttggattgcctctggtttttaccatgttaggtaatactaattttatctggaaaccattttagctttttggattgacagctttagttattgtttcagtcagttcttgctgcgtaacaaactgcccccaaaggtactggtttaaaacaaaggacatttattctttctctcaattctgcaggttcactgggtgattcctttgtcctgggccagtttggctggggctggatggcctcattcacatggctggggcctcagctgggggcacttggagctttgtcctcatgtgttctctcactgcccagtgagctagcccaggcaaggaaggacatgccccatatacaaacacttcttaggactctgtttgcatcacatttgctagtgtccctttggcaaagtgagcccatggctaagcccagaatgaggaagtacaatacatcctctgagtatctcagtgagctggatactgaggcttccagagtctcatagacacagaaagtcatgattccctgggggccataattgcaaagtttattaatatattatcctatatgtattaatcctgtaggtcctaaggaaataattcaaatttggggcagggaacaaagctctatgcataagattttcatcagtagcaaaatatgcaaaccactaagatgtccatccattggagaatggacacatggaagacggtgcatccatagaattggtggatgaagagccattgaaaatgatgtttgggggccaagcatggtggctcatgcctgtaattccagtgactcaggaagctgaggtgggaggattgcttgaggccaggagtttgagcctgggcaacacagccagaccccatctctgcaaaaaaaaaatttcaaaattagctaggtgtggtggtctatgcctgtagtcccatctacttgggaggctgaggagagaattgcttgagctcaggagctccaggttatagtgggctgtgactcactcactacactgcagactgggtgacagagcaagaagactctgtctccaaaaaaataagataaaatgtttgggatgacctttgttcagtgtaatgtagaagttaaaattacatgctctggagtttagttcgtttgtgttgttatcccccagcagttaagaatccccctgtatctgctgggtgcagtggctcacgcctgtaatcccagcactttgggaggctgaggcgggtggatcatgaggtcaggagatcgagaccatcctggctaacacggtgaaaccccgtctctactaaaaatacaaaaaaattagccgggcatggtggcgggcgcctgtagtcccaactacttgggaggctgaggcaggagaatggcgtgaacccaggaggtggagcttgcagtgagccgagatcacgccactgcactccagcctgggcgacagagtgagactccatctcaaaaaaaaaaaaaaagaaaaagaaaaaagaagaaaaaggaatccccctgtatccagactagcttatgatagaggaaaagcttcttagctcccagagttgaacaactgaagagcttctcacatggctggatccaggattcctttgggtcggttgcatcttttttttttttttttttttttttttgagatggagtctcactcactctgtcatcctgtcatccgggctggagtgcagtggtgcagtctcagctcactgcaacctctgcctccctgtttaagcgattctcctgcctcagcctcctgagtagctgggattacaggcacccacgaccacacccagctaatatttgtatttttaatggagacgaggtttcaccatgttggcctggctggtctcgagctcttaacctcaggtaatccacccaccttggcatcccaaagtgctgggattacaggcgtgagccaccatgcctagcctgggtcagttgcatcttaacggctcctggcagtgagcccagtagcccctggttgtccaccggtggttgtagtggttccaaacctcatttctttgcagtgccaaacccagaggaagacagagtgcatcccagcattcccagctagactgaggtcatgtgacatccagtgcccaatcatgtgaccagaggaatgctgtatgctgattggcttgggcatgagggattttttttttttttttaatttagaaacagctttattgagctgtaacttacataccataatattcactcccaccacatgctagagagaattttgtaaatggagtaaaattacactccaacagtataaattgtgcacataaaaataaagttttaggccaggagcagtggctcacgcctgtaatcctagtaccttcagaggccatggtgggtggatcacctgaggtcagggttcaagaccagcctggccagcatggtgaaacttcgtatctactaaaaatacaaaaattagccgggcgtggtggtgcacgcctgtaatcccaactactcgggaggctaagacaagagaatcacttgaacccgggaggcagaggttgcagtgattccgagatcacaccactgcactccagcctgggtgacagagtgagacaccatctcaatatatatatatatatatatgtaaataaataaataaagttttacatcactttttttcttgatcaaagcaatgctaggtaattaaggacattgttggcaataacagaaatgtgtctatgaaaaggttcttaagaaggtgactgtaacctcacattctcctttcattttctcccccatctctgcttctctctagggtgaacacagttggtctgggtgggattggggttgtgctgtgtggggcagaggctgttggggattcgtgatgggaattcctaatagtgacccttgggtcccaggaacaggagacacgggccagtcaaaggcatgggaagaagctaggagaagttaggattcgagttaaatccagtgccaacagggtgaccagttgtctaggtttagccaggactgagggctccctgggatgtgagattttcaatgtccacactcagaaagttctgggcaaatggggacaagttggacacagaagcagaaaaaaaatcaaggagggtctgcagtggaaacgggcattgttcactctgcagaatctgtattcttgctgtcaacaatgccccgaacttcctctggaatctgctcctcacccttgagtggctctcacctcccactctcaaccccagcctggtaccagggcaaaacacaaaactcagccccaaattagccatgacaaaaatgcaaatcaagaccacgatgcaataccacttcatgcccacgagcgtggcaaaaaacaaacagacggacaataacaagtgtcggtgaggatgaggagaaatcggaaccctcatacattgctggtgggaacataaaatggcacagctgctttaggaaagagtttggcatttctttcattctttcttttttttttttgagatggagtctatctctgtagcccaggctacggtgcattggtacgatcttggctcactgcaacctccgcttcctgggttcaagtgattctcctccctcagcctcttgagtatctgggactacaggaacccacgacctcgcccggctaatttttgtcttttagtagagacgaggtttcaccatgttggtcaggctggtctcaaactcctgacctcgtgatctgcccgcctcggccttccaaagtgctgggattataggcgtgaaccaccgtgcccagctggtggaaggtattttttttttcttttgctagtttcataaacaaagccacctctagctatttaattgcattttcagtatctcccgttaaaaaaattttttttttcagagacagagtcatggtgtgtcacccaggcccgccatccgccaccatgcccagataatttttttttttttttcaaacagagtcttgctttgttgcccaggctggagtctcgctttgtggcacacgcctataatcccagttactcaggaggctgaggcaggagaatcgcttgaactcgggaggcggaggtcgcagtgagccaagatcatgccactgcactccagcctgggtgacaagagcgaaactccgtctccaaaaaaaaaaaaaaaaaaaaaaaaaaagaagatgcatttcccctttgtcctggatagcagctaccttgggtttctatatttgcttatttgtccctctctactcggtgactcattccacttggaagaaactttggactggagttccctgcccccacccctgccaccagactgatttgttttcttgctgttattgtcacacgataagcatggggttgttggctttttttttttttttttttttaacatttctttctcttctccactctccacccccctcctaaatgttccagcccggttctctgcatgcactattagcttggaactgtgtcgaaaacttttcagagttttgggctcgatgcttgcaggtttcatggtcttattcccaagagcctcctgtctcttctcataagttctggaattatctctagttacgtgcttatcacagggtatgtttcccactttgcaaatctccatttgggtggatcccaactgttttatttatttatttattattttattttatgtgtttatttttgaggcaaagtataccacattttctttttctttttgagacagtcttgctctgttgcccaggctggagtgcagtgtcacgatctcgactcactacaaactctgcctcccgggttcaagtgattctcctgcctcagcctctcgagtagctgggattacaggcgcacaccaccacaactggctaatttttgtatttttagtggagacggggtttcaccatgttggcaaggatggtctcaatctcttgacctcgtgatctgcccgccttggcccctgaaagtgctggaattacaggcatgagccaccgtgcccgggcttcaactgtttttataatgattaaaaaaaaaaaaatcgaaaggcagcaccgtggcaaagaaagagcttttttatttgtccttagacattaagcacatttatccatttggttctgatgtgacagaggctgggagttgcagggaaaggcaggaaatctggcataggccctgcagatccttcatttccactcttttctaattttgctggatacatggcaaaaatattctgcagtggtcttaaggagaagttctagagccagacagttctctttttttagtttctttctttttatttatttattttttttgagatggagtcttgctctgtcacccaggctggacttaagtggcgcgatctcggctcactacaagctccgcctcccgggttcacgccattctcctgcctcagcctcccaagtagctgtagagccagacagttctgagttcaagagctggccctgccactttgcagctatgagatctcggacaaaccatataatctcttaaaccaggggtcagtcagtaagctatatcccataggctaaatgtggcctgctgcctgatttctaatgatttgtgagctaggagtcacttttgcattttatttatttatgtatttatttttgagatggagtcttgctctgtcacccaggctggagtgcagtggcacaatcttggctcactgcaacctccacctcctgggttcaagtaattctcctgtctcaccctccaagtagctgggattacaggcgtgtgccgccatgcccagctaatttttgtattttgggtagaggtgggggtttcaccatcttgaccaggctggtctcgaactcctgacctcaggtgatccgcccacctcggcctcccaaagtattgggattacaggcatgagccaccacgccctgcccacttttgcattttaaaatgattaaaggaaaaacaaggagagacgtgaaccaaagggtgcaaagtttcagatgggaggaatacgttctaggaatccactgctctgtagatgaatggtgactatagctaataacacatattgcaaaatggctagaagaatagattttaaatgttctcacaacaaagaaataagtacatgaagtgatgaggatttaattagcttgttttaatcattccacaatttatactgtaacataactttacactgtaccccatacgtgtacacaactattatttttatttttgtttatttattttagagacagggtctagctctgtcacccaggctggagtacggtggagccttcatagctcactgcacccttgacctcctgggctcaagtgattcttccgccttagcctcctgagtagctgggactacaggtgcgaaccatcgtgcccggctaattgttctattttctgtggaaatggggtctggctatgttgcccaggttggtctctaactcctgggctccagcaatcctcccttcacggcctcccatagggctgggattacaggcacgagccactgtgcctgacctataatactgttgtcaattaaaaataaaacaaatgatttttagaaagataatattatggaaattaatattaatagaaaatagataatagggctgggagctgtggctcacgcctgtaatctcagcactttgggaggccgaggtgggcggatcacttgaggtcaggagtttgagaccagcctggccaacatggtaaaaccctgtctttactgaaaatacaaaattaggcaggcgcggtggtgagcgcctgtaatcccagctactcgggaggctgaggcaggagaatcacttgaacccgggaggcagaggttgcagtgagccgagattaagccattgcgctccagcctgggcaacaagagtgaaactccgtctggaaaaaaaaaaaaaaggaaaagaaaagaaaccatcagggtttaatgctcagcttctggcttaggaagtctggctcttaccgataatgataacctctgcatatatctttatccatagcactatggttataaaattctgcaattctcaaagtcgcttatgtgtcttagtctgtgctttgctgccttggcgtcatttctgagcaggatcctggctgtgagctccctgcgaggggtggacactcccagatgtgcaaagctcagccaccctccttctcctcctctcttcctcccaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactattgtaagtctccatggcagcctcagctgactggggctgtgcttagcactgagcatggtgggacattgcaggggatgacttggagaggccgcaggtgctggccctggccttgactctcaggcctatcagctgctgcggtgcttgccctctttgatcctgcactttttttttttttgagatggaggcttgctttggagtgcactggcacaatctcagctcactgtagcctccgcctcccgggttcaagtgattctcccacctcagcctcacagtagctgggactacaggtgcccaccaccacgcccggctaattcttgtatttttagtagagatggcatttcaccatgttggccaggctggtctcaaactcctgacctcaagtgatccacccgcctcggcctcccaaagtgctggaattacaggcatgagccaccatgcctggcctgatcctgcacttaaaaaaaaaaaaaaaagtttcagaggtacctgtgcagttcattatataagtaaattgtggctgggcacggtggctcacacctgtaatcccagcactttgggaggccgaggcgggcagatcacaaggtcaggagatcgagaccatcctggccaacatggtgaaaccccatctctactaaaaatacaaaaataaattagccaggcatggtggcgggcgcctgtagtcccagctactcaggaggctgaggcaggagcctcaggaacccgggaagcagagcttgcagtgaaccgagatcgtgccactgcactccagcctgggcaacacagtgagactctgtctcaaaaaataaaataaaataagtaaattgggtgttgttgggggtttgctgtacagataattttgtcacccatgtaatcagcatagtacctgataggtcgttttttgatcctttccctcttctcacccaccactctcaagtaggcacctgtgttagtctgtacttacactgcaataaagaaatacctggccgggcacagtggctcacacctgtaatcccagcactttgggaggccgaggtgggcggatcacttgaggtcaggagttcgagaccagcctgaccaacatggtgaaaccccatctctacccaaaaatacaaaaattagctgggcatagtggtgtgcacccgcagtcccagctactcaggaggctgaggcaggagaatcacttgaacccgggaggcggaggttgcagtgagccgacatcacgccactgcactccagcctgggtgacagagtgagactctgtctcaaaaaataaaaaagaaagaaagagtgaaagagagagagaagaaaaagaaaaagaaagaaaaggaaagaaagagagaaaaagagagataaaagaaagaaaaagaaagaagagaagagagagaggaagaggaagaggtctgagactgggactcagtaatttataaagaaaagaggtttaattggctcccagttctgcaggcagtacaggaaccatgatgctggcatctgctcagcttctgaggaagcctcaagaaactttcaatcatggtggaaggtgaagtgggagcaaggtgttaagacggggagatggtgctacacacttcttaaacaaccagatcccatgagaacccacttattatacagtacccagtagggatgttgctaacccattagaaaccgcctccatgatccaatcacctcccacccggccactcctccaacattggggattacatttcaacaagagctttgggtggggacacagatccaaaccatagcagtcccggtgtctactgttcacttctttctgtccatgtgtggtcagtgtctcactctcacttatgggtgagaacatgaggtagttggttttctgtccctgtgttaattcagttaggataatcacctccagctccattcatgttgctgcaaagaacatgatctcattctttttcatggctgtgtagtattccatggtgtgtatgtatcacattttctttatctggcaatcctgcacttcctcatctgtacatggagataataacagaaccacttcaggaggtggagggacattttaatgacacaaatgttaagtgcctggcacctgttgctagtgtctccatctttgttactagagttttttggctagatgaggtggctcacacctgtaatcccagaactttgggaggctgaggcaacaggattgcttgaggacaggcattagagaccagcctgagcaacatagcgagactctgtctccacaaaaaaatacaaaaattagccagctatggtggtgcatgcttgtaatcccaggtacttgggaggctgagacagggggatcacttgggcccaggaatttgaggttgcggtgaactgtgattgtgccactgtactccagcctgggtgacagagtaagaccctgtctctaaaaaataaaaattaaaagaagtttacatctgtcaaaagtcatgctgggatcgggactagctatgtaatttgcaagacccagtgaacaatgaaaatgcagaactccttgctttaaaattattaagaatttggccgggcacgttggctcacgcctgtcatcccagtactttcggaggctgaggcgggaggatcacctgaggtcaggagtttgaggccagcctggccagcaaggtgaaaccctgtctctattaaaaatacaaaaattagccgggtgtggtggtgcatgcctgtagtcccagctacttgggaggctgaggcaggagaatcacttgaacccgaaaggaggaggttccagtgagccgagatcgtgccactgaactctagcctgggtgtcagagcaagactctgtcacaaaaataagtaaataaataaaaattaaaataaaatgaataagcatttcagaggggcaacagcagagcattaaactgacagaaaagggtcctgcatccactgcctgagatgtgggagggatggaaatgagcagtgatttggggcaggggtggggaagagtgtgcttccagaatactgacctctgagcccactgcctggtcccactgcacctacgggactgtttcgggactgctggaaaatcaggatgtggaagagcagcagagaggtttatggacaagggagggaaggaacagggtggcccacccattccaggagtggatgtgatttttgatgtgaactttgttggaaacacattgatatgaaacatatattttcttattctatttcagtagacgtcccgtcaaatattgcaaaaattatcatcggccccctcatctttgtctttctcttcagtgttgtgattggaagtatttatctattcctgagaaagaggtgagttcagtgagttcagtggtgtgctgggaacagttggttctctgggggaaaacatgccttgatataggtataggcatatttaagtttattatgaattttgctgatataggatgtgtaacatgcaatttacagataattgtcataatatgatatacacaactctttattgtaaattccctctagacagttgattctcacagaatgtttttattgatttttttttttgcccaaacctttatatccgaagctaacctattattgcaattgataaacaagtaaagctccaatgtgaatgttgattaatttttcaaaatttacattaaggagtaggacttgactgggcacagtggctcacacctgtaatgctagcactttgggaggccaaggcgggtgaatcacctgaggtcaggagtttgagaccagcctggccaacatggtgaaacctcgtctctactaaaaatactaaaaaattaaccgggcatggtggtgggcgcctgtaatcccagctactcaggaggctgaggcaggagaattactgaaccctggtggcggaggttgcagtgagctgaaatcgcaccattgcattctagcctgggcgacagagggagactccgtctcgggaaaaaaaaaaaaagtaggacaaaactgaaataagacatatatgttcatcagtgatatgagtgacgtctttgctgagtcagatggtaatttttaaatatcagaagaacattttgtgccacatgcaacatcacagttgcagacatgacacgcttttaagtttaatctacatgattaaacatttttctcagctgggcacggtggctcacacctgtaatcccaacactttgggaggccgaggcgggcggatcatgaggtcaggagttcgagaccagcctgaccaacatggtgaaaccccgtctctactaaaaatacaaaaattagcaaggtgtggtgatgtgcgcctgtaatcccagcttctcaggaggctgaggcaggagaatcgcttgaacccaggaggcagaggttgcagtgagccgagatcgcaccattgcactccagcctgggcaacagagtgagactttgtctcaaaaacaaaacaaaacaaaaaaatatttttctcatcactttctcaagcctggacaaacaacagaacaacaaatccagtcctgagttatagcatttgccagtttctgtaatgtaaatattcccaggatgtctaaattcaagctgtagacataatattactgagtgcagtgttagaaagagatacataatagctccccattgaatccaccctatggatacaatatggtgtataaatgatataatgtaaataacctcaactgcattgatcatatttaaatgtagtatgagagttaggaagtgatgagttttgaacatgtattgtctttgcttttaggataatttatttaattgtaagcctctataatttatattttttgttctatttggaaggcattgtacaatttaatctttaatgatgcttgtatttaacaactggctcactagtttcctgaaaatttaataattgtttctcatcagtcgggatgagctcgctctagaacagtactgggtgagtggcttttaagtgttacatggatggccataaattatttaaaaagccagccagagccctgcatggtcgtgcatatctgtagtcccagccgctcgggaggatgaggcaggaggatcacttgagaccaagagttcaagaccagcctgggcaacatagtgagaccctgtctatatgaaattttacaaattagccaggtgtggtggtgagcacctgtattcccagctattcagaaagctgaagtgggaggatctctggagcccagaaggttaagactgcagtgagctatgattataccactgccctccagccacaacagagcaagactgcaactctgaaatgtaaaaacaaaaacaaaaacaaaacaaaaaaaaaaccacccagggagggatgagtgctcccatgttgatgcacttacatacctgtctgatgggcttccattcaaaacataaaggtcccccatccctgccctagactgcatctaggattatggggattctgctggtaagggctgccatttgccttggggagtcttgtatgaaacacctttctgcagagtcccatgagaatctcaagctaacgtgcctcgttttcctcctccaggcagccagatgggccgctgggaccgctttacgcttcttcaaaccctgagtatctcagtgccagtgatggtgagtaccatcccttccctgtgggtggccagaaccctactcatcagcttcctttgccttcaccattgagtgagagtgaaggatgggttccccagggaggccaagaaaagccctcttattcatttgagcttgccaaactgcccttgctgcagaaacctcattactgtgtgcatctggacacatggtatttggcacctgcctgaatgggctcatctagccggtctgggacccttgggcagggtcgaccacttgggctgggctcagctgggcagttcttctggtcttgcctggcttcacccatgtagctacattttgctggtgtgtcagctagcactcggtagtcttagatgatttcactcacatgtctggtggtcagtaggctgggtggtcccaaggtgggggccctaagctgggggaggctgagcctcactctgtccatctagcctcttaggctccagcaggctggctcaggcttcattccatggtcctctgttggttcctagtagaaagctccagggcaagctccagggcaacagtccattccaaatctctgcttggacaattcttgttgattcccattgaccaaaataactcacaaggccatgcccagggccaaggggtggtgagatagactccaccttttcatgggaagagctccaagtatcctggctttttttttccccaacctattacaacctgtcttccatccccttggcactttgcagaaacagtagtctcaggtgggaagtagcatcattccatagcaagggtctgaaatcagacaagaaggatggggatgcaggtttgcctcaggacatattggccaggatcttggaccagttgtggctccttccttgagtctctgccatgccctctccatgggtgcagatgcctgtcctgttctcggccatatgcccagtgcccggcatgggtcctggatcacagaactcatttcatgagtgttttcgagggggtttgggtgagggcttgggtggaaggtggctgcagacccccaagggatcctccaaggatgctgtgtagataagtaagaagtagtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgagtccagtgggggtgggacatgggctggctttcctgacccttccctttctctgcctcctcctcctgcacagagcgacagaggacacagggtgtaacctcctacccacccctcactccactaagcttcccatcctagaggtgtgaggagggatcattcccttctcaaatcccatcctctcccacttcgcctggaaccagactctatcactgtctcatcactttctggaatgtttcattgctttccagaatctttcatcactttctggaatcttccatcattttctggaatcttccaccactttccggaatcttccatcattttccacaatcttccattgctttttagactcttccatttcttgctttttcctggcacctttgtaacccaggaccacatagaggtccacctgataccacctgccctcgttcctactctcctttgaaggcagcaccaactcttcctgcctttctgctcctttgttcctctttgagtcctatgtgctttcatccttgccacacatatttatggggcatttaaagccctgctcttgtccctgtgatacagtggatacctgcccctgtagagcttccaaaacagcaggcggagacagactccaaaacctttatttttattttatttcatatatatatatatatatatatatatatatatatatatatatatatatattttttttttttttttttttttttttttttttttttttttttttttttcctgaaacggagtctcgctttgttgtgcaggctggagtgcagtggcacaatctcagctcactgcaagctccacctcctggattcacactattctcctgcctcagcctcccgagtagctgggactacaggcgcctgctaccacgcctggctgattgttttttttttttttttttgagatggagtctcactctgtcacccaggctggagtgcagtggcatgatctcagctcactgcaacctctgcctgctggattcaagcaattatcctgcctcagcctcccgagtagctgggactgcaggtgcctgccaccacgcccagctaatgctttttatacttttttttattagagacggggtttcaccatgctggccaggctggtcttgaactcctgacctcgtgatccacccgccttggcctcccaaagtgctgggattacaggcgtgagccaccacgcccagtgcctggctaatttttttgtattttcagtagagacggggtttcactgtgttagccaggatggtctcgatctcctgacctcatgatccgcctgccttggcctcccaaagtgctgggattacaggcgtgagccaccacgcccagcctatttttatatatttttaagacagagtctctctctgtcgcccagagtggagtgcagtggcacaatctcggctcactgcaacctctgcctcccaggttcaagcaattctcctgccgcggcctcctgagtagctgggataacaggagcccaccaccacacccagctaatttttgtatttttagtagagatggggtttcgccatgttggccaggctggtctcgaactcctgaattcaggtgatccaccggcctcagcctcccaaagtgctgggattacaggcataagccaccacccccagctgactccaaaccctttatacattaggagcaaatgctatggaaacatgaagaaagggaggaaaggagggttggacaggggtgtatttgagcaaagacttagaggacatgaggagctgggccctgtggatgtggcagggaacagagagccaggcagagggaatgattaaaatacaaaggcctggctgggtgcagtggctataatcccagcactttgggaggctgaggcaggcggatcaccagaggtcaggagttcaagaccagcctgaccaacatggagaaatcctgtctctactaaaaatacaaaaattagccgggtgtggaggcgggcacctgtaaccccagctactcgggagactgaggcaggagaattgcttgaacccgggaggcaaaggttgcagtgagccgagatcacgccactgcactctagcctgggtaacagcaagattccgtctcgaaaattaaaaaaaaaaaaatacaaaggcctatctgtctgctgtccgggcaggtatgtctgctctcctagaccagggctgagcacgctgcatccaggccacagggtgctgtgtgtgacatagacaccagggagggaggagaaccctggtgagtcgaatcacggaccctcctccaagaaccctggttgcttgctctgcaggtgcgcctcctgggagtggtgtccaagggccagcccacgctggtggtgatggagctgatggctcacggagacctgaagagctacctccgttctctgcggccagaggctgaggtaagctgcttcgggggacccagcggggtactcggtggagcacccgctcctggcctcctcggatcccagtgctgctgaaacaccaaccccgtgtttctgttttagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggaggttcgtctggctttctgctttgaaaacataacgacccaggccaggtttgatttcagaaggaagttgtctataatgagccgttaagtcttttctgataatataaaggggcaagatacttcttttttttttgtggggttttttttgttttgttttgtctttttgtttttgagacggagtcttactctgtctgttgcccaggctggagtgcagtggtgtgatctcagctcactgcaacctccacctcccaggttcaagtgattcacctgcctcagccttccaagtagctgggactacaggtgtgcgccaccatgcctggctaatttttgtatttttagtggagatggggtttcatccatgttggccaggatagtcttgatctcctgacctcgtgatcctcctgcctcggcctcccaaagtgctgggattacaggcgtgagccactgcaccggctttttttttttttcttttttctgacatggagtcttgctctgtcgcccaggctggagtgcagtgacaggatctcggctcactgaacctccacctcttgggttcaagcgattctcctgcctcagcctcctgagtagctaggattacaggcgtgcgccaccacacccagctactttttgtatttttagtagagacggagtttcactgtgttggccaagatggtctcaaactcctgacctcatatgatccacctgtgttggcctcccaaagcactgggattacaggcatgagccactgtgcctggctgggcaagattttggatggggaccccccaccagctgtcatttaattgcatgtattgataaactcacttacccattcacttctttaaaagatatgtttgtaggaccgggggtcccgcctgtaatctcagtgctttggaagtccaatgtgtaaagactgcttgagtccaggagtttgagaccagcctgggcaacatagtgagactccatctccttgaaaagattttttaaaaagtggggtgtggtggtgcacacctgtggtcccagctactcaggaggctggggtgggaggattgcttgagcccaggaggtggaggctgcagtgagctgtgacagcatcactgcactccagcctgggtgacagtgagacgctatttcaaaaaacaaataaaaaaggaatatagaggggaccagagcagcgtgagatgtgaggatgaggagagaggcagaaaccagacccagaaggaccttgcgtgtcacagcaagtcatctcgacattatcttacattagcaaggggcagcaggaagtgatatgattctatttatgactcaaaaagacatctcctggccaggtgcggtggctcacccctgtaatcccagcactttgggaggctgaggtgggtagattacctgagatcaggagttcgagaccagcctggtcaacacggtgaaaccctgtctctactcaaaatacaaaacattagctagacatggtggcagacagctgtaatcctagctactcaggaggctgaggcaagagaattgcttgaatcagggaggtagaggttgcagtgagccaagattgcaccactgcactccagcctggaggacagagtgaggctccatatcaaagaaaaaaaaaaagaaaaatgtagcttctttgtgatttggtaccttcttttccctccctttaaacagtagcccatcttcccccttcacttccccatgcgtaccctcagaatccattcttactggatttggccaccacccaggtgagcgcagacgtgggccaggtgaacccctcttagggctctgtgagaggtggggcagtcaaggtggcagatgctaggaccaaggctgaaggttaagagcgtgtgaaccttttgtgttgtcagactttggaatgaccagagacatctatgaaacggattactaccggaaagggggcaagggtctgctccctgtacggtggatggcaccggagtccctgaaggatggggtcttcaccacttcttctgacatgtggtgagttgtgtgtggatgggtggatggacgctgggcttgaattccaggtgctagtgagagccaagagcgggggaaggaagcctgccatcctcctggacgccccatcaaggaaaggaaggcagcgtcctgtcttaggatcttcccacggctactcttatgtcctgactaatcctgtaggcattgtgaaccccgaaaatctgagacaggtctcagttaatttaggaagtttattttgccaaggttgaggacgtgtgcccgtggcacagcctcaggtggtcctgaggacaggtgcccaaggtggtcagagcacagtttggttttatacattttagggagacatgagacatcagtcaacatatataagatgaacattggttcggtctggaaagacgagacaactcgaagtggggagggagcttccaggttgtaggtagataagagacaaatggttgcattcttttgagtttctgatgcgcctctccaaaggagccaatcagatatgcaggtatctcagtgagcagagtggggactctgaatagaatgggaagcaggtttgtccaagcagttcctagctggactttttccttgagtttagtgatttgggagccccaaattgattttcctttcacagcatttatgaactgcagcatgaattgttttattaagtggctaaccatgttctagaaaccaagagatgtgtttgtgtgtgtgtttgtgtgtgtatgtgtgtgcatatgtgtgtttgtgtgtgtttgcatgtgtgtgcgtgtgtgtgtttgggtgtgtgtgtttgtgtgtgtatatgtgtttgtgtgtttgcatatttgtgtgtgcatgtgtgcgcatgcgtgtttgtgtgtatttgcatgtgtgtgcacgtgtatgtgcgtgtgtgtttgcatgtgtgtgtttgcatgtatgtgttggcatgtgtgtttgcgtgtgtgtgtgcgtttgcgtgtgtgtgtttgcgcgcgcgcgtgtgtgtgtgtgtctaaatggcttctttgttactactatcaactgtcatcggcaggtcctttggcgtggtcctttgggaaatcaccagcttggcagaacagccttaccaaggcctgtctaatgaacaggtgttgaaatttgtcatggatggagggtatctggatcaacccgacaactgtccagagagagtgtaagtgtagaaagggtttaaggtgtgtgaggtgttcgttgaaagggtattgccctttacacgtgtgcttggttttgcctttcctatgtctacacgctcaccgtgtttgcatgctgtatgttacaggtgtgtttgtgtttgcatagcttgtctttacatgcatgcttgcatttgcatattgcattgtggtacacacacttgagttcccatatgtgctacatgtacgcttacgtttgcatattatatatttacataggtatttatgtttgcatattatatgtttctgtgtgcatcagcatatcatggcacatgtacacctcatttacatattataagcacacatgtttacatattatgtctttacctgcctgcttgtgttcacaaatcatatgattttcttgcatattgtatctttggaaggttgcacaaaacacctatagcggtagttatcttgggagaagggaactggagacctggggttgggggagagagacctgtttgcctgttaatttttttttttttttttttttttttgagacggaatcttgctctgtcacccaggctggagtgcagtggtgcgagctcggctgacttcaagctccgcctcccgggttcacaccattctcttgcctcagcctcccgagtagctaggactacaggcacccaccaccgcgcctggctaatttttttttttttttgtatttttagtagaaatggggtttcaccgtggtctcgatctcctgacctcgtgatccacccaccttggcttcccaaagtgctgggattacagccgcctgttaattctttatacacttaaaattttgtcaggtagctgggcatgggtggctcacgcctgtaatcccaagcaatttgggagaccgaggtgaacgatcacctaaggtcaggagttcaagaccagcctggccaacatggtgaaaccccgcctctattaaaaatataaaaattacccaggcgcggtcgtgggcgcctgtaatcccagctactcaggaggctgaggcaggagaattgcttgaatcggggaggcagaggttgcagtgagcagagactgcaccattgcactgcagcatgggtgacagagtgagattctgtctcaaaaacaaacacagacacacaaaaattttgtcaggcatacatattatatattcccccctccaaatatatatgcatatgtacatatatatatatttagatgaagtctcgctgtgtcacccaggctggtagagcgcagtggcacaatcacagctcactgcaaccttgaactcctggactcagcctcctggctcaacctcccaaagtgctgggattactcttgagccagttttgaaatgaggaatcccttttcaaaaccatctttcaggctggacaggatggctcatgcctggaacctcagcactttgggaggttgaggcaggaggatggcttgagcccaggagttcaaggctgcaatgagctatgattgcgccactgcactccatcctgggtgacaaagtgagaaaccctgtctcaaaaaaaaaaaaaagcggccaggcatggtggctaacacctgtaatcccagcaccttgggaggccaaggtgggtggatcatttgagcctaggagtttgaggccagcctgggcaacatagcaaaaccctgtctctgcaaaaaatacaaaaattagctaggcatggtggtgcacacctgtggtcccagctacttgggaggccaaggtgagaggattgctcgagcctaggaggcagaggctgcagtgagctatgatcatgccactgcactccagcctgggtgacagaatgagacgctgtgtccaaaataagaagaagaaaagcaaaaagaaaacaccatctctcagcacctctagcaatgctatttctgccttgacaattgtccacacacacagccagcatctgatgtgagcacatgtggtccgtgggtgtcggctgcagggacaagagtgggggtttgggaggatgcgtggcagggcccccagactcacccaggacgtgtccttctgccccgcagcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatgggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaaaagaacatggtggactttcagggagtgcaatggaaggtgaatatttccttaagggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaattatctgagaatacgcttgtttttgtgtggtgtcccggtaaggacctgtcgtgtggtcgggggatgtggctatgagttgggctgtgttaaggaaaacctcttggaatatgtaggtgcctttttttagaggagaaaaacacctagattcttccacacatgaaaagggaggttaaatagttgctaccagcagagttgatgactcgtagggacatacttgtatggccaaactggtggtttaaatattgcactatttccataccatttggtaagtaagcgcttccccaagggctcccagacctccccatggtccaaccactaaagggttcactccgagaataccaatgaaccttcaagatcttgctctattctgacatgcgggaaactcatatgttaagtattttcaatgtcatcctgggagtggagacctgtcccaggttgggtggacaggtgagtgaccatgggttagaccatgggattgaaagccttttgaatagtctttcttgagtggcttaaaacagcaactgtttatttattttctttttttgtttgtttgtttttgtttttgttagtttgttttttgaaatggagtctcactctgtcacccaggctggaggacagtggtgcaatctcagctcactgcaacgctgtctccgggttcaagcaattctcctgcctcagcctcccaagtagctgggattacgggcgtgtaccaccattcccagctaattttgtatttttagtttcatcatgttggccagactcgtctcaaactcctgacctcaggtgatccgcccgcctcagcctcccaaagtgctgagattacaggtgtgagccaccacacccagccttattattatcattatgatgattatttttgtatttttagtagagacgggttttcgccatgttgcccaggctggtctcgaactactgttctcaagcgatctgcccgcctcggcctcccaaagtgctgggattgcaggcatgagccacggtgcctggcctgtttcttacagttctatgtgttggttgggtggttcttccgggaacagcctcactcctgtgctgaggcctctgctgggagagccaggattgcttgtcttctaggaggttcactcaggcttgttcatatggtggtggttgcagggatacccagtcggaaggaacaaaaagcccccaaatgtaaatattttccaaacttctgctcgtgtggtatttgctactgtcccattgcccaaagtaagtcccatggccaaacccagagtcagctttggagaggactgtccaaggatgcagataaaaggtgatgtgaaccaactagagtccaatcctgcaataatcttccactcctttaccctcctatcattattattatatttttttaataatataaaagtgggccgggcgcggtggctcatgcctgtaatcctagcactttaggaggctgaggcgggccgatcacaaggtcaggagatcgagaccttggccaggagatcacctggccaacatggtgaaaccccgtctctactaaaaacacaaaaattagctgggcgtggtggcgggcgcctgtagtcccagctactcgggaggctgaggcaggagaatcgcttgaacctgggaggcagaggttgcagtgatctgagatcatgccactgtactccagcctgggcaacagagtgagactctgtctcaaaaataaaaaaaaaaatactactactactactactaataataatataaaggtaaagttctcactttaccatcctattattattattattccttgtttttgagatgggagaaatagcagtatggatgatgacagggataatccagtcatcagagggaaaagagatgaaggcaggggatcactagctctatgtccttaagcaaacaagtgacgatgagatctacggcacaggtggaggggttgaccttagctaaagtgcaaagtatgtgggctgtggaatctctctccctcccaaaggcaatggaactcaatccccaacccct

SEQ ID NO: 32 - DNA, 1364 bp, Homo sapiens
ccttcgcgccctttggcaagctcggactcatcttctggggattgccgcagtgacccagtaatgggaagggattgatttccaccttgcggggtatggggcgctcttaggaggactctggagaagtagttgtcctgggagaggagcgatcttaatcctgctgcatgacgggaggacaaaatgcgacgctgcagctattttccaaaggacgttacggtgtttgataaggacgataagtctgaaccaatcagagtccttgtgactggagcagctggtcaaattgcatattcactgctgtacagtattggaaatggatctgtctttggtaaagatcagatgtcatcgcaacagataaagaagacgttgccttcaaagacctggatgtggccattcttgtgggctccatgccaagaagggaaggcatggagagaaaagatttactgaaagcaaatgtgaaaatcttcaaatcccagggtgcagccttagataaatacgccaagaagtcagttaaggttattgttgtgggtaatccagccaataccaactgcctgactgcttccaagtcagctccatccatccccaaggagaacttcagttgcttgactcgtttggatcacaaccgagctaaagctcaaattgctcttaaacttggtgtgactgctaatgatgtaaagaatgtcattatctggggaaaccattcctcgactcagtatccagatgtcaaccatgccaaggtgaaattgcaaggaaaggaagttggtgtttatgaagctctgaaagatgacagctggctcaagggagaatttgtcacgactgtgcagcagcgtggcgctgctgtcatcaaggctcgaaaactatccagtgccatgtctgctgcaaaagccatctgtgaccacgtcagggacatctggtttggaaccccagagggagagtttgtgtccatgggtgttatctctgatggcaactcctatggtgttcctgatgatctgctctactcattccctgttgtaatcaagaataagacctggaagtttgttgaaggtctccctattaatgatttctcacgtgagaagatggatcttactgcaaaggaactgacagaagaaaaagaaagtgcttttgaatttctttcctctgcctgactagacaatgatgttactaaatgcttcaaagctgaagaatctaaatgtcgtctttgactcaagtaccaaataataataatgctatacttaaattacttgtgaaaaacaacacattttaaagattacgtgcttcttggtacaggtttgtgaatgacagtttatcgtcatgctgttagtgtgcattctaaataaatatatattcaaatgaaaaaaaaaaaaaaaaaa

SEQ ID NO: 33 - DNA, 2099 bp, Homo sapiens
tcccggaggcgagcgcgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactactggtaaaaaaaaaaaaa

SEQ ID NO: 34 - DNA, 1509 bp, Homo sapiens
acagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagaatcaaacaaaccctgagcatttatcttgcctcttctatataaagtttaactcggcataaccaattgctgatgaagaagaaatgtttccttgtagaagcaaaccagtgaataattgaagaaaaaatttatcttttcaacatctaatgagttaatggattcaagcaaagattatccacggctgttaacaacacaaaaagacaatcggaaattagctattactgcgggaagtacccaataccatctatgaaactgtgtggacaaaaacactgacaaaaatctccacgaatctctaattttgaatacaaatttaaagaaaatgcaaaggattaaaatagaccatgatgaagtcagaaaaattcagacagagaaaaatgctccaggaccagaaacccatttcttccgcaaaagcttccaggtagagattgactgaccgagagaacagagacatagagagaacctagagattaaaagaaacttgagcgatttgtcagcattcagttgcaacgtatggatgtgatttgaattctaatttaaaaaccaaagtagaaagtggtaaacaattggggaaatgtgaacaatgatagaatatttaatattaatgaaatatgttaaatattttcagatatgataatggcattgagtatgtaaaaaagagcctgtttttaaagaaatacctctgaaatacagatgatataatatcatctgtatattagatgatattatatatatcagtatcatcagaataaagtaaggttagcatgaattgttaattgttgacactgtgcaataggtacgtggataattactatactgttctcattccttttatttatgtttgaaatgttctaaaattaaaagttaaagcatagagtgtaaagttgagcaaattcctccaagacctaaatatagcttatcaaaacttacattaattagatgctgactgttgagctaatacttttttttaatgatgtgtgcttcagtttattgcacttttcaaatactccagttttttgtgtgcgtgtgttttttaaattttattattattaaagttttagggtacatgtgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 35 - DNA, 2584 bp, Homo sapiens
acttccggcgggaggcggaggcggaggcgcaggcgctggctggcaggtgtcgctaaccggacggtggtcgccagggcgagaggcgggagccggagagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaacattttgaactctaaaaaaaaaaaaaaaa

SEQ ID NO: 36 - DNA, 504 bp, Homo sapiens
ggcgcacccgggaggcggggccagcgaggcaagatggagttagtgcaggtcctgaaacgcgggctgcagcagatcaccggccacggcggtctccgaggctatctacgggtttttttcaggacaaatgatgcgaaggttggtacattagtgggggaagacaaatatggaaacaaatactatgaagacaacaagcaattttttggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgactaaacaatgaaaaaaaaa

SEQ ID NO: 37 - DNA, 604 bp, Homo sapiens
cctttcatcctggcgtttgcctgcagcaagatggcggcggtgtcaatgtcagtggtactgaggcagacgttgtggcggagaagggcagtggctgtagctgccctttccgtttccagggttccgaccaggtcgttgaggacttccacatggagattggcacaggaccagactcaagacacacaactcataacagttgatgaaaaattggatatcactactttaactggagttccagaagagcatataaaaactagaaaagtcaggatctttgttcctgctcgcaataacatgcagtctggagtaaacaacacaaagaaatggaagatggagtttgataccagagagcgatgggaaaatcctttgatgggttgggcatcaacgatggagctatgacattgaagagaggaaggttccaaaacccaagtccaagtcttatggtgcaaacttttcttggaacaaaagaacaagagtatccacaaaataggttggcactgactatatctctgcttgactgtgaataaagtcagctgtgcagtatttatagtccatgtataataaatacatctcttaatctcctaataaattggacctttaaactacagat

SEQ ID NO: 38 - DNA, 580 bp, Homo sapiens
gctgcaaacgtctcgctgaggtcatcctttacggcaggcgtccgcgtcgctagctagtcgttctgaagcggcggccagagaagagtcaagggcacgagcatcggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatcctatttgttctattttctcttggaaaaaaaaaaaaaa

SEQ ID NO: 39 - DNA, 733 bp, Homo sapiens
tgcctggcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaa

SEQ ID NO: 40 - DNA, 19291 bp, Homo sapiens
agaaaagaaaagaaaagaaaaaaaaaggaatcagtcccttctcataaagcatttacattcgagttgtagtttcagggtccttgtttgtttcccatctgtctgtctgtctgtctctctctctcgaccaacctgtgtagagtgttttgcgaaaaacacacatgtacaagttactagattgactcttttttttttttttctgaggcagagtctcactctatcacccgggctggagtgcagtggccatgatctcagctcactgcaacctccgcctcccgggttgaagcgattctcctgccccagccttccaagtagttggaattacaggcgcgtgccaccaatcacggcaaatttttgtattttttagtagagacgaggttttgccatgttggccaggctggtctcgaactcctggccttccaaagtgctgggattacaggagcgagccaccgcgcccggcctattagattggctctttatccctgctgaacatctctagttcttcttcgactcactttgaatcctggaagcaccactacattaaatgtctcttcatactaataagaattttcgtccaaatcgcgcaatcacctccagggccaggaaaggggacccccggtcgggagtgcggactgggcgtggtcactgaccccgagcgtcccctccttctggctgacacgcggctgcagacgcaggagcctcctgctggcgactggagtgtcactataaataattgaggccaacacccgcggagtgacattccaccccggtaggcctggcctacagctcccagcaagcctcgcgcaagctcgtggactccatctcccggcgggccggcactgccctgccgggcggtcaatggcccgctctgagtaggtttttccgtttttacctgacagctgagaatgtctggaagcggaggggcggtagcagcctgcctgggaatgggccaccccgaatcccgacccgaaataaatgcaccagcatgctgacgcggtaaaacaggagccgccggcaatagcagtttcaccctcatcccactgagggctctatgttggctcccgcccccatcccgacaaccccctcgcgccttggcggtgattggtgaaaagacacatcaatctcacttcaagctgtgattggaggatatgttgtcagccccctccttttggaactgtgattggagggaatcgcctatccgcccgccccctgctctgggcggagccgagcaggaagtgggcctggcttttgccaggtgctcctgtgggctccgggtgacgtccaaagggtgtggcccgactggccctccaagctatggagtatccatagtaacgcgtcagccgccgacctcgggccattttcccaaggctccaggatctctagatgtcccgtcgtctcaagggcgtgtagaacgcgggttttgggggaggaatgaacaaaaatcgactgggagttttttcaaaacacgtacatatgccctgccacccaccccgctctcctaggtgcgtcagaactgctgggacatctgtcacgtgaaggggtgggttgcccctccacacctgtgggcgtttctcattaggtggaaggagagacttggaaaagaaagagacagagagacaaagtatagagaaagaaaaatgggcccaggagaccggagttcagtttacggaagatccacgccggcaccagcctctgagttcccttagtatttattgatcattatcgggtatggcaggataataggataatagtggagagaaggtcagaaggtaaacacgtgaacaaacgtctctgcatcgtaaacaaggtaaaaaaaaaaatgctgtgcttttgatgtgcatacacataaacatcacaatgccttaagaagcagtattgctgccagcctgtcccacctccagccctaaggcggttttcccctatctcagtagagataggctttacaccgagacatttccattgcccagggacgagcaggagacagaagcctttcttttatctcaactgcaaagaggcattccttcctcttttactaatcctcctcagtacagaccctttatgggtgtcgggctgggggacggtcaggtctttcccttcccacgaggccatatttcatcacatggggagaaaccttggacaatacctagctttcctaggcagaggtccctgcagccttcctcagtgttttgtgtctgggtacttgagattagggagtggtttgagattagggagtggtgatgactcttaagaagcatgctgccttcaagaatttgtttaacaaagcacaccgtgcacagcccttaatccatttaaccctgagttgacacagcacatgtttcagggagcacagggttgggggtagggttacagatcaacagcatctcaaggcagaagaatttttcttagtacagaacaaaatggagtctcctatgtctacttctttctacacagacacaggaacaatctgatctctctttcttttccccacagtcacgtgtacttggggaagaactcccccggtgattctgacactcttgccctacgcctcagccattgagaactattggtatggagggcctgtaatttatcaaggcgcggcctcagatctgtctgcctcgcagataccttcctcacccgggtcagaatgacttgcctcaggctcctgccaaagagtttgcaccactcgtttcttccctgtaattacttgtttgcgtatttgtctccccactgggctgcagcttcttgggtagtggctctgttttattcatctgtcctcttcccttccaaatgcttggcaaggaaaagtgccctttaaaataaatcgacttgaattgggagtggtggtagggaggctgtcaatgagaatgaattcagggtgaaactaggtaggacaatgtcccaggattagtttggggttgagctggggagctcttggtgtatgggggggtcctattgtgactatggtggaatagccacgatactgagtgacattgggcgagtgaggtgggggagagactagacaacaccccacataacccatcttgacagatgtctcagaaagattatgggaatttcctggcccctctgcaatgtgggattccattttgctacctctagaaggacagggtcttgttttcatagctctgcctcctactctgagataaaggcatgcaagacctgagctactactacaataccccacacagaaggagaaaatcaggcacatctggattcaagttttgtgggtgattccatgattgcctccagtgaacaatctgggaagcacagtgtccatatcgccatttcaggggtactggccccaacatcagcccttaggcctaagccctagagaccttgacacctggtggctgagtcagtatctcagtaatgggctttagaaggaaacctggtgattcagggcctcaagaatggcgttgggcaagccaccagaccagctgcctgggtctcctcctccttgttgaggtgacaacaaggaactcagttcagctcctccctgggtatccaaattatccttccaagtcccagactcacagctgtcctcccttctgattcagccctgatgcttttcagggggtcccagaagtgggatccggacttgagagaatgtcacagttgaaaatgataaggatgcaaacggaatggaactttcagagaaccccaattttctactctaagttctccaaaccaactctcaaatccaagatagctgcctttcctttcttcacctcctcttcttagttttccccaacttggctgcaaagtcagcctcccctcttctcttccttagcacctcagaccaataaaacatgcaaccttttcttattctttttaaaaaatttatttttgaccaggcgcagtggctcacgcctgtaatgccagcactttgggaggccaaggcgggtggatcacgaggtcaggagttcaagaccagcctggccaacatggtgaaaccccatctctactaaaaatacaaaaaattagctgggtgtggtggcacacacctgtagtctcagctactcaggaggctgaagcagaagaatcacttgaacttgggaggcggaggttgcagtgagccgagattgtgccactatactccagtctgggtgacagagtgagactgcctcaaaaagaaaaaaaattattttgtttgttttttagattttgtagagatggtgtttccctaagttgctcaggctggtctcgaactcctggcctcaagtgatcctctcgcccgggcctcccaaagtcctgggattacgggtgtaagccaacatgcctggcccctttacttcttcttttctgttttggtcacaaaacatttctctgttgatcactgtagtgtgtgtgtggagggaagtgggggaggtacactcttaagaaatgaaatagttaacatcttggtcctaagatttgttgtagagatggagtcttctcattctgttccccaggctggtcttgaactcctggcctcaagcaatcctctttcctcggcttcccaaagtgctgagattgattacaagtgtgaggtactgcgccctgctacaatcctttaataggatgtttttggggggggtggcagggggcaggatctagctcactgtaacctatactgttccagtgtaacctgcaccaagccatcctcccacctcagtctcttgagtagctaggaacacaagcacacatcaccacacctggctctaacacgattttgctttttgcttttgtcattttggctgctgttctttttatctttcattcattcaaggtctgaagatggagataataggaatcttctcatctcaatgtgctctttggcccctcctcttaaactgatgcccctctcaggccctgagggatttggcctcaggttgccctggaaggggtgtgagtgatcagacaggtgactgagagctgggacgcctgaggcctgcctaggctgagtcacctagtaatgttgttgtcattgttcctgttgaagtcccagctcagtgtcacagacctttgtggaagcaacaacagctcccatccttccaacctttctggagaagccgtggcctgatggtgagccgaatgggctggggggggagaagaaggcggctggggcggtggggagatctggggcccggatcggtgcccctcctccccatgccactgccacctcctcctcctccttcatgccggggacctgggggagggaggatctccatcttctctctgtcccctgcccctcatacaagaagctccccctcctcattttcccctcccaccgcagggcccccttgctcagtgctacaggggacaggggcttctcagtcttgccacagtgctctccctatcccagccacccccccaacacaggctcaacctgcaatgacacctgcctctgcatctccctcctggggatcccactccaccccacccctggccccggcaacccccactccctcacagcagtgcccccaggactctcctgggctgcgggtaggccctttgatccctgaacaggattatgagcggctggaggactgtgaccctgaggggtcccaagactcacccatccacggggaggagcagcaacccctgcttcatgtccctgaagggctccgaggtatgtgtgtgggtgtgggtgggagagggttagtggtgcctgggagctccagtacttatcccaggctgggcctctggcagcgggttgagaacgtggagaattgatcacatgccaggggctgacactctcccctctgtgcccaggctcctggcatcacatccagaacctggacagtttcttcaccaagatatcctttgcgctaggcctgcagaggtggcatgggaaggtcctcttggagctggcactgttcttggcagggagactccgtgagggcgtcatgggtgggagacttgttggggctgaggggaggtgtcctcaggagaggccccccgtgcctcaggcttgttccttgacacgcagccacatctacagctaccaccagcggaatggctttgcctgcatcttgctggaggatgtcttccagctggggtgagacgcttagcccgggcccggaactcggtcccctgggcccatggcttccttctgtcattttgcttccttaattgtgccagctgcttccatcccatgctttcccgagcagcccaagggctcagcaggggcagggtcagggaggataaccatgggctgctctgggggctggggcaggagcccacctggctgtccctgatcactgcagcatcccggcacccccccttcctcccggcagacaatttattttcattgtcaccttcacaaccttcctccttcgatgcgtggattacaatgttctctttgccaaccaaccaagtaaccataccagacctgggccgttccacagcaaagtgaccctgtcagatgccatcctaccctcagcccagtgtgctgagaggttagtgacaacctggtggggccctgggggtgaagcatgggcagtgggtagaggagtagacgggagccccactttgtcccgtcatctagatcagcagttctcaaagcttttggtcttaggaccaaaaatacacttaatatactttaagttgtacttaagtgtattaagttgtacttaaagtgtattaagtatatctttttttttttttaagacagagtttcactcttgttgctcaggctggagtgcaatggtgaggtcttggctcactgcaacctccacctcccaggttcaagcaattctcctgcctcagcctccccagtagctgggattataggcgtgcaccaccacgtgtatttttagtagagacagggtttcaccatgttggccaggctggtctggaactcctggcctcaggtgatccacccactttggcctcccaaagtgctgggattacaggtgtgagccactgtgcccggccttttaagtgtatcttaattacagtgcattaagtgtatcttaatacacttaaaattggttgagaatcctgaaaagcttttgtttatgggagtcgtatctatccacattttaccttataaaaaattaaaattaggccgggcatagtggttcacacctgtaatcccagcactttgggaggctgaggcaggaggattgcttgaagccagaagtttgagatcagcctgagcaacaaagtgagaccacatctctataaaaaataaaaattagctgggcttggtggtgcgtacctgcagtcctagctaagcctagtcaggaggctaagacagtgactgtctctgatcactgcagcatccctacaccctcctccctcccagcagacgattcattttcattgttgccttcacaaccttcctccctgaagcatggattgcaatgttctctttgccaaccaaccaaataactgttccagacctgggccgttatttggcagggagataggagctatgtttctactgctgcactacagcctgggtaacagagagagaccttgtttcaataaaaaggaaaaaaaaaaaagaaggaaattgtagctgagaacaactttaaaatgtaagagtgcggctgggcgtggtggctcacacctgtaatctcagcactttgggaggccgaggcgggcggatcacaaggtcaggagatcaaaaccattctggccaacatggtgaaaccctgtctctactaaaatatacaaaaattagccaggtgtggtggcgggcgcctgtagtcccagctaccctggaggctgagacaggagaatcatttgaacccgggaggtggaggttgcagtgagccaagattgcgccactgcactccagcctgggcgacacagcaagactccatctcaaaaaaaaaaaaaaagagtgtacaagcacacatttcatcagctgtcagtgtgatgtgacatgttcacgtgtcttgtagcctctggaaaactccactgtactctcagagtacaagaatgaaaacatcagaaagcattagtattatttggaaaaagtttgactttgcacatttgtgaaggccacttcagcacccaccccctgccccgggctctaccttgagagctgctggtctagctagatccccctcctcatgatggtttttcctcactcccgaagtctggtctgcctctttctcaggcgcccacctttctcccccactgcccgcccaaccccatacaggatccgctccagcccgctgctggtcctcctcctggtcctggctgccggcttctggctggtccaactgcttcgctcagtctgcaacctcttcagctactgggacatccaggtgttttacagggaggccctgcacatccccccggtgagctgggtggctgtgtctgtgcagagggtgccgtgagagggtgggcagaggagaggggaagaagtgggactgtacaggtggaagggccaactggaaagagggcagaaagagcgaggtcttattgacacctgccctaggcccagaataatgtcaggagggggctaccaccacctagagagcatggcccttaccctaagggagtttagtttatttagatggctcatataagatgacatatagttacatgtttgtgctaaaaacattgattagagaaaagagaaagggcagttatctggcttttcagagctggaggaatttgggttgggcttcggaagggcaggacaggaggggaggggagcacattctaagccccagtgcaggaaggtggggaaaagccatgagcttttggaagctgcagtgaggagatggacccatcagcctaaaacagagccttcaaagccatcccccgcattgcaggaagccactgcattggcctgtcactgtccactgcttatgctctgccctttgtttcctcaccatcttgagtctgctcctccctcctctgtatctaagttctttctttgaggcacagcttgaaagtagccttctgcagcttgcttcccttgctcccctgggaggtccggagccctctgcacagcctttatgtgcagcaaggggagaggtcttagaaggcccctgagcagaggagagggaggaggccggggaagcagaggtggtgagagcggaagctggacctcggattggctctggcgggagactgctcacccgtctcgttctcctcctcccttctttcccctcctcccctgttccttccaggggaagggaagggaagacactgggatgtactggagaggccagcctgggggacttgactaacctggactgggaaagctgagtgaaactgggctgaagtgaggtttgcagccttcaaatgagatctgacagtgccccactgccagatgtggacatagcccaggtcctgggaaggcttctggtgacagagccgaagatggcctggagtcgggtggggctgggagtgtaaagcatgcccaggcagaaggtggggaggattctgttccagagttggtgggtgcactagaaatgggaaggagagattctcccacgaactgccagacattctggttttttgtttttttgtttgttttgtttcttttgagacagggtctgggtctttcacccaggctggagtgcagtgctgtgatattggctcactgcagcctctgctccccagtagctgcaaccacaggtgcacaccaccacgccctgctattttttgtatttttagtagagacagtgtctcaccatgttgcccaggctggtctcgagctcctaagctcagacgatctgcctgcctcagcctcccaaagtgctgggattacaggtgtgagccaccgcccctggccagccagtctgttttgtgtgtacaactgagggggcctcaggcccttaaggagctgagaagccaggtccagcacctggaggcgtccccaggaagtgcatgactactggccacatgaatggcagggatgatgaacagggcagtttagaagaggatgaaggaagtagggcgcgcccttgttagtgacagggttaagggagggcagaaagagaaaggtgggagagggggacgatgtagcttggtcatggcgagtttgtgatcgcaaactcagtttgcgggttttcaggccgcacacttaggggtgtggagcttgagcatcactgtggagaggaatggggggtcgctggctctcatcagtgcccctttcaggaggagctgagctcggttccctgggcagaggtgcagtcccgcctcttggcactgcagcggagcgggggcctgtgcgtgcagccgcggcccctgacggagctggacatccaccaccgcatcctgcgctacaccaactaccaggtggcgctggccaacaaaggcctgctgccggcccgctgcccgctgccctggggaggcagtgcggctttcctcagccgcggcctggcgctcaatgtcgacctgctgctcttccgcggtcccttctcgctcttccgcgggggctgggagctgccgcacgcctacaagcgcagcgaccagcggggcgccctagcagcgcgctgggggcgcacagtgctgctgctggccgccctgaacctggcgctgagcccgctggtgctggcctggcaggttctgcacgtcttctatagccacgtggagctgctgcggcgcgagcctggcgcgctgggggcgcgcggctggtcccgcctggcgcgcttgcagctgcgccacttcaacgagctgccgcacgagctgcgcgcgcgcctggcccgcgcctaccgccccgccgccgccttcctgcgcaccgctgcgccccccgcgcccctgcgcacgctgctggcccgccagctcgttttcttcgcgggtgcactcttcgccgcgctgcttgtgctcaccgtctacgacgaggacgtgctagccgtggagcacgtgctcaccgccatgaccgcgctcggggtcaccgccaccgtcgccaggtgcgacggcagatgcccggggtggtggtgtgtgttggtttctctgatctggggccatgtgaggttccccccgaatccttacctctcccaccactggggccctctagccctacatcccaccgcgcgtcctcctaatcgcaggccccttccccccacggatcccgcctttcaggtctttcattccggaagagcagtgccagggtcgtgcgccgcagctcctgctgcagacagccctggcccacatgcactacctcccggaggagcccggccccggcggcagggaccgcgcctaccggcagatggcgcagctgctgcagtaccgagcggtgagggtgggcgcgacggcgggctgaggaggaagttgtggggtctgtctgcgcggagggtctgtctgcgcggagggtctgtctgggagagggcatgagacaaacggactataccaggagtctagggagtgactgggtggggaggcttcttgccctggcgagggtcgctggggactgcttggtcctgataacgcgcgtgggcccctcagcgacccctgctcagcctcaccgctgcttccccaggtctccctcctggaggagctcctgtccccgctcctcaccccgctgtttctgcttttctggttccgccctcgtgccctggagattatcgacttttttcatcacttcactgtggatgtggctggggttggggacatctgttcctttgcccttatggatgtgaagcgccacggacaccctcaggtcagagccgttccctggccctgggggtttgggctgggtgggagttcgcttgcctctcgggagcagacctgagttccagccctggctccattgcttgctacctgtgccgttgagcgggtcacttcccttcctgtgctctcgtgccctcgtctgtcagatggcaacaatggcaatgtgctctccagagcacagccaaggccaggcttgtgaacacacagattatgtctgtatagcctatgatggagttgctggcacatagtaacgtcagtaaatgggagcaaagaccacctgggggtgaggaatgggcttggccggtgggtggggctgagtaaggactggtgcctggaccaaggctgtcaggatcaccctgggcaaagcactgaggctcagccctatccccgagctggcaatcagtccaggggtgacgaatagatgacaggcccaggttctgcactgctgctgtatttttgggtgatggtgaacaagtccccattgtggtctgtttccttcacgtggaagatggggcagtgtttcctgtcccacctgttcccataaggctcagtgttcttagcacctgaaagactgtccttgctcacagtggctctcggcgggacagactgaggcctcgctgtctcagcgtgcggaggacggcaagactgagctttctttgatgcggttctccctggcgcatccactctggcgccccccagggcacagctctaagtttcttgggcacctctggggccgagtacaacaagatgcagctgcctggggtgccacctcggctcgcggcccctccaccccgggggtgctcagcaactgcacctcgcccctggtgagtcccaagcctggcctccccttctgccttcacccccacaactcctctccaaacccttcccctctaggctcaccttaggtagtaacctgcctcaccagcccccgcccccagcctgctctcctgccttctttaggcctctgcttcctccctactccgtttctgtcctctcttctgactccctctttggctttccctctcctcttgcacccagcctgaggccttcctggccaacctcttcgtgcaccctctcctgcctccgagagatctgagcccgacagccccctgtccagctgcggccacagccagcctccttgcctccatttcccgaattgcccaggaccccaggtgaggagtggaggctgagatgcaggggcatgtggaggggggtgggctgatcctgtaggagtggggagctggggcgctgaggggggattcagaaggggagtcctctggggtgtggcgggaggagggcatgacttttgacctgcttcatgttatgttccagctctgtgtccccaggaggcactgggggccagaagctggcccagctcccagaacttgcttctgccgagatgagtctccatgtcatctacctgcaccaggtgagtagaggggtgcccaaaggagaaatgtggagagaaggcaggtgaacaacatggagactgaggtggggtggagtctacggaagggtctagcagagtggcaggaggaggctgaaaagccctctgcctctagcccaggtgcttggccctgccctccttggggtgcagccctcattcctcctcctttccatgcagcttcaccagcagcagcagcagcaggagccgtggggtgaggctgcagcctccatcctgtccaggccctgctccagcccctcacagccaccctcgcctgatgaggagaagccatcctggtcaagtgacggtgaggagggtggggcctgcaggggacagagcctggtggacactgggcatcatggaactgcccagctgatggcctttttcaccaggctccagtcctgcctctagccccagacaacagtggggaacccagaaggcccggaatctgttccccggagggtttcaggtgaccacagacacccagaaggagcctgaccgggcctcttgcactgactgagacgactcctcagggtcagtattgcctcctgtgaggggagggagaaaggacggcataggtagttggtttggagtccgacttgaagcgatgggagcagtggtgggaatttggggtgatgggaggtggtcatctctggaatctagacccctggactgcttgccaagagccgtctcctcccacaggtaccctggcttcggcagccacaggagattggagggtggagtagaaaaacacaaggagtcattgttagaggccccatagatgacaggcccaggtgctttagttgggcaggacctgggagtcagtgaggaactcgccccgagaacagagaaaaggtaggcaaggagaggagatgctgatggcatctggaaacaagtcttagagatggtctgcacccagagggaataaggggagacatccccaactggaatgtgtcctggagcagctgcctgggaagaagtcctcgagtttcctcaaggtgggggacagaggtcaaggatgaggccgagctaaatggaagggcgacagtgaggcaggtgggctttaaggctgtggattcgtcatgctggcggctgccagcagcactttcaggttccttggggcttgtaggggatggggacttgtcagtggaaagacgggagggatgatgtttttggacttcagtacgggtgtgatgtcccaggaagtgggtgtggctccccatcctgtatgaaataagcagtaaagcttgctcatggctgttgcacatctctgtgactcttgtttctggcaggccccactcctggcagctgagtgctgcacctgccttctcgatcacgagcctgagaactgcacgggggagcagcccagactggctggaaaccatgttttcagagtgcagggtcaagtggcgtgtaggactctgtcaaaagaatgacccctttccccaccacatacccacaactgcacaggttaaaacagaaatcttgtcattttataattgtaatccacgccgggtgcagtagctcacacctgtaatcccagcactttgggaggctgaggcggttggatcacgaggtcaggagttcaagaccagcctggccaagatggtgaaaccccgtctttactaaaaatacaaaacctagccgggcgcggtggcaggcacctgtaatcccaactacttgggaggctgaggcaggagaatcacttgaacttgtggggtggaggttgcagtgagctgagatcacgccactgcactccagcccgggcggcagagggagactccgtttcaaaaaaaaaaaaacaaaaaaaaaaaactgtaatccacatgagctggggtaggcactttagtagttctcctaacatctggcacagtcccttatggtaaatcttcaataataaatacttgatttagagattagactttacaggtaagatactcctgagagaggcaagaggaatctaacattcgactaagaaacaggaagcgggtggcagtaggccctggggtaccgctgctgggaggggccttccagattaaggcggacccaggcccgaggcaacaggcctagagagggaaaagaggcgttttgctccttcctggaggaataatgctgaatccttgcagcctctggacagatgtgagaaggcaccacctcaagaggggaggagcggggctgatcctggtcgggcggacctgagtcgggcagccgctctcccggaactggaagggaaagccaggcggctctcaggggctgttggtgtctgagccgggagggtcgaacgcccagggcactgcgccccgcaactgacgctcctgcaaggaaaagctctgggtgcgtatgcggcttgtcacctcctgggtgcgcagcgtgagcccgaaaatgtcttcgtggtagcgttgctgatcctgtcggaaaagagcacagtggatcagaacccgactcggagaccttagcaggaaccccgcacgctcaggcccggcccgcccctccgcacccgcagcacgccgatgacgtcgccggcctcgtccagctccatgtcgccctccgtcgccaggatgcgctgcacggtctgcaggacgttggttgccatggtaacatcgccgcagacaaacatgtggccccgctcgaggcacagcacgcggtgcacctccgcagccagctccgtcctcaggatgtcctgcacgtaggtctgcggggcggcggggttagggcgggccctggtgggggtgggcgcgggggcgcagcccggggctgctggctggccctggacgtgaaagtctccggagcgggcctggtggggcctgcgtgccctggggcggtgtcaacaggggcagagccaaaggggcggggcaggggcgggaggaggcgggcctagaggggccggggcacaagggtgggccagagtgtgcaggggtggctgagtggtcgtgggaggccacgggagggccgtggttggtgtgccccgctggagagcgcgagtcctcccctctctccctatcttcaggttaccattgcgccctcagggtctcacaccttggggttgtcaggttcccgggagaaggcggtgaggactcggccaaacaccccgcgctgctgggcgttctgcacctcgtcgcggtagagatggtcaagttgggagcatcggcagccgaacaccaaagtcatgggagtgggctgcagccctgcaagcaaccccgcgcttgggaaggctcttctccggggcacagtgctagtggggcctccccacaggccaccgtcgcccagcctggcagcccagcgttttgggctgaaaccaccattactttggctgtttcatctctaagagagtgtagaatgctttcacagagaccctgcacagccctgatttacagagggaagggaagcgcgggtgaggtggtggcccctggtggagctgcgctagaatgcgcggcttcggactcagaattccatgccctttgcattgtgtgacatcgcagtccccttccccgctcccacttcatattctcccatacttataactctcctcccagtcacagccctcttcttttgattgacagaccaccctgggcaccccatgctcaatatgaacaccttgtagcatccttaggtcttggacagacctcggtcagctctggcacagtcaagaatccaccttgggcagttcttctttgagtcttagccctaatccctttgaaaattctattttcctttgtcctcaatccagtcaacacctactatgtaccaggcaccaggaagccagaagctcagggcccagcccttgcctttggtacctgccctccccttggtctcatgagcgtcttttcagctttgtggactttgtttcctgccctctctttcctatttcctgccttccagccccacccctctgtccctagattgtgtgactcccttcaggcagtcctttagtccccagcctcacctttgctctcaatgtcatgcagccgctcctgccagaatccccggaagggggcaatgccagtgcctggacccaccaggatgcagggcaagctgggatcgggtggcagccggaaggagggagccctggcaggagagacactccatcaggtcccctttgcctttcctgctccaccattctcaccatgcagggtgggtggagcaaggaggacccaagttcttcccatctcaaaaaaaaattaaaaaaaaaacaaaaaacaaaaaacaactctacttgctgaaactccttggatctgtggtttctggagattgcaccaaaggaaatatagttcattttggattgaagaatacttagatgactcaggggatttagaaaacgtgggaagggtgaaagacactttcagttcataatgggttcactaagtgtgtttattttaagtatccttaatagtggtatttagtttatgttcagtagatgggtacggtttatttgtagtttagccacctgggtggatttgaatcaccaggcccagctgatggcagcctaggaactgttctcagtcctaccaggacttttggttcctggctgcgagagcgggcaagacttctggacacagcatgaaggaagggtctcttaaaatccttcaccctcggtccgggcgcggtggctcacacctgtaatcccaagactttgggaggcggaggtgggaggatcgtgaggtcaggagctcgagaccagcctggccaacatagtgaaacaccgtctctactaaaaatacaaaaattagctgggcgtggtggtgggtgcctgtaatcccagctactcaggaggctgagacaggagaatatttttttttttttttttgagacagagtctggctctgtcgcccaggctggagtgcagtggcacaatcttggctcactgcaagctccacctcccaggttcacgccataggagaatctcttgaacccgggaggcggaggttgcagtaagccgagatcgtaccactgcactccagcctgggcgacagagcaagactccatctctgggggaaaaaaaaaccaaaaccttcaccttctttgagtccttggtgacaccaaggccaagggtggtcttaaccctaactagtagttctccctggattgagtgaggatttagtgactgtagttcccaggtgccatgctgcccaacatcagacagcccagggacatagagaggaacacagaagctttcagaaagccacagggccagccggtttgatcccagctctggctctgggagctatagtttcagggcagaactctgagtctaaatgaatgagagagccaaagcttagccagagttctgaagtgacctaatgacaccacacccttgacatgttacagagctccttcctgtttccagtgacacccctcaccagtgacactcctcaccaaagctgccaccctgaccctgggcagctccccaccaagtcttccatctcacttacccccggatgaagcagggcacagggtctccgggcttgagctggcttagccacgtggagcagactccatagtgcagggggcccagcccatctgggggtgggaaggagaggccggtgaggggccagagaggggccggtcccaaccctgctgtggccaggcctgctcctgcttgttgcctcaccctgagtcctgtatgccagcacagctacagtgaggtggatctctcctgggtgggtgctgggtgccgagctgactgagtagtaccggggctggagcagaggcagctgggtgaggagcagtggggcaggcagcgccaccgacgggaactgctccagcacctccagcagcgtggggcagcggaaccacttccactcctcgtagcgtcggggatcctggcggggcaggatgcagtgggttggaggccccatagcccttcctagtaacctcccttcttgacccctcccccactgagcctctttagggtttctccctgctcagttcaggccaatagagttttctctaagacctggagaatccagccatgaattcctccctgaggagctgggtcttaaagcaccagtgcatgtcggccaggagaagaaagtccaggggggactttgcatgggggtttcctgccactggggtccccccagctcatcccgtctctctagcccctgtgcctcattggggtggcccccaacctggctgagggcctccagctcctgctgttccctgggctcttctgccaaggtgctgagcagccgcaagagctgagggctg

SEQ ID NO: 41 - DNA, 12268 bp, Homo sapiens
gccaagtgaggtggctcatgcctgtaatctcagcactttgggaggtcaaggcgggtggatcacttgaggtcaggagttcgaaaacagcctggccaacacagcaaaaccttatctctgccaaaaatacaaaaattagctggacatggtgatgagtgcctgtaatcccaactactcagaaggctgaggcaggaaaattgcttgaacctgggaggcagaggttgcagtgagccaagattgtgtcactgcactctagcctgggcaacagagtgaggctctgtctcaaaaaaagaaaaaaagaaaagtggacagagaccaaggaacttgtggaataccattaagtagaccaacatatgcattacgattcccaaagaggggttagagaaaggggcaaaaagattatttgaagaaatggctgcaaacttcccaaatttgatgaaaggcactaatctacaaatccaagaatctcaataaactccaagtaaaataaatccaaagagactcacactgagacacattataatcaaactgttgaaagacagagaatcttgacagcagcaagagagaagcaactcataatgtacaagtgatcctcaataacactatcagctgaagtccaatcactctgagggaaaagaaaaaaaaaaagactactggccattttctcagcagaaaccctggatgccagaacgcagtgggataatacatttaaagtgctttaaaaaaaaaaaaaactgtcaggacaggcatgctggctcacacctataacccccaacactttgggacacaccaaggtagctgtgtagatcactggagcccaggagtttgagaccagcctgggcaacatggcaaaactttatctctacaaaaaaacccacaaaaattagttgcacctgtagtctcagctactcaggagcctgaggcaggaagatcacttgaacctgggagatcaaggctacagtgagccatgatcacaccactgcactccagtctgggcaacggagagagatcttgtctcttaaaaaaaaaattatgcgaaatctactctgcctgtgttctataaagggaacaacaaagcctggatgacagcatatctgtttaccctacagtttgctgaatatgttaagctcattattgatacctacccctcagaaaaaaagattcctatcaaaatattattgcaggctgggcacagtggctcatgcctgtaaccccaacatttaaggaggccaaggcaggaaaatcacttgaggccaggagttcgagaccagtctaggcaacacagcaagactcagtctccattaaaaaaaaaattactgaccattgatagtgcaccttgtcaccctatagctctgatcgagatgtacaaggagattaatgttgttttcatgcctgctaacacaaaatcttttccttagcctgtggatcaagaagtacttttgactttcaagtctattatttaagaaatatattttgtaaagttatggcggccatagatagcaattcctatgatggatctgggcaaagtcaattgaaaaccttttggaaaggattcaccctcctagatgccattaagagcatttgtgattcatgggaggaggtgaaaatatcaacattaactggagtttagaagaagttgattccaaccctcatggttgatgttgaggagtctaagactttatggagggatgtaactgcagatgtggtagaaacagcaagagaactagaattggaagtggagtctgaagatgtgactgaattgctacaatctcatgataaaactttaagagatgaggagttgcttcttctagacaaagtggttttttgagatgacatctactcatggtgaagttgctatgaacattgttgaaatgacaacaaaagatttaaaatatcatataaacttaattgacaaagcagcagcagggtttgagaggactaactccaattttgaaagaagttctaccgtgggtaaaatcctttcaaacagcatcacatgctatagagaaatctttcatgaaaagcatagtcaattgatgcagcaaacttcattgtcttattttatgccaccccaaccttcagcaaccaccaccttgatagtcaacaaacatcaaggcaagaccctccaccagtaaaaatatgacttgctgaaggctcagatgatcatcaacatttttaagcgatataatattttcaaattaaggtatgtacattgttttttaaacatgttattgcacacttaagagactacagtatagtgtaaacataactttttctttttttttttttgagatggagtttcactcttgttgcccaggctggagtgcaatggcatgatctcggctcactgcaacctccacctcccaggttcaagcaattctcctgtttcaacctcccaagtagctgggattacaggtgcccaccaccacgcttggctaatttttgtatttttaatagagacgggtttcaccatgttggccaggctggtctcaaactcctgacctcaagtgatccacccacctcggcctcccaaagtgctaggattacaggcatgagccaccacacccggcctagtatttttttttttaagagatggggtcttaccatgttaccaaggttggtctcaaactcctgagctcaagcgatccacctgcctcagcctcccaaagtgctgagattacaggcctgagccaccatgccggcccaacataacttttatatgcactgcaaaacaaaaaaatccctgtgactcactttattatgatattggctttattgtagtggtctggaacccaacccacagtatcttccaagtttgcctgtacattttagctatctattattaaacaacttagtggcttaaaactacaataattttatttatttgcttgtaattttgcaatgtgggctcaaatagcctttctttgctccacacgcagtcacctgaggtggctccagtgggctggagaatccactttttaaatggccttcttcacgtggctggcaaaagttggtgttgactgctggctgggagttcaactgaggctgttggcccaaacctcagttcttcttcacatggttggttgggcttttcacaggcagtaagtctgagaagtcaaacttctaacacagcagctggcttcccccgaatgcaaaaacagaagctatcaggccttcttaaggcatagtcccaaactggcataacatcacttccaacgcattctactattgattaaagcaagtgacaggcccaatcagactcaagagaagagaactcctaaaggtgcaaatattgggaagcctggttcatttggggccaccaaagtagcagtgtactgtaagatagtcaccctgccaagtgttctgtagctgtatatttgtaattacttctaattgtattgagttttaaaagtaatctctaaaaaaaaatcagtgtttccatatcaaaaatctattgatgtttataatagcatccaacatatgcaagtgttagctcataccactaattattactaaatcagtattatagttctttgcctcctattttcgccatatctgtcaggtacattcataatcgttccaaatgagcagtcactgaaataatttcaggttattgtatctttctgaaactataatttgttgtttagaaagtaatctgcatattgagagactttgtaagggttcaaacataatcaaactccacctttctgaccagtaacttttttccctgaagatgaatgcttttaacttcaagaaacagaacacccaagcaacagacttagagtctaaacagtaaagacctttaatcatctttttttttttttttttgagatggagtctgtcgcccaggctagagtgaggtggctccacctcggctcactgcaacctccacctcccggattcaagcgattctcctgcctcagcctccctagtagctgggactacaggtatgcaccaccacgcccgcctagttattttgtttttttgttttttgtatttttagtagagacaggatttcaccatgttggccaggctggtctcgatctcttgacctagttatcgagaccacctcagcctcccaaagtgatgagattacaggtatgagccactgcacccggccaagacctttaattaacttacacaacaaagtctggagataggcagttccaagcatggtacagcagctcaatgatatcatcaagtatttgggtgttttctatctttgccctcaaccatcttcagcacgtgagtttttctttcctttttttttttttttttgagacggagtctcgctcttgttgcccaggctggagtgcagtggcacaatcccggctcactgcaacctctgcatcccgggttcaagtgattctcctgcctcagcctcccgagtagctgggattacaggcgcccaccaccacgcccggctaatttttgtatttttagtagaaatggggtttcaccatgttggccaggatggtctcgacctcctgatctcgtgatccacccacctcggcctcccaaagtactgggattacagacctgagccaccgcgcccggcctgcacgtgagcttttcatctggaaacttgtcccctcatggtcagtcctcacaccaccccacttacagaagaaaaaaatggaaaggtgaagtctcctctggaagcttcgtctttttatctgggaggaaaatatttcccagaagctgccttcttttaatttctgtcagactctagactaccctcaaatttcactggacctgcgattacaatattacctagcaataagaatcaaaagaatcgaacatcattgagtgggaaaaatcctctgcaagtacagccaagccttttctgaggctatttttaaacttacaaatcagaggacaatcgcgacattagaggaaaattacccaggtttacgccatcactaacgatgatagcttacgatgatagctaacccagctcttcaacttcctttcaatctccagaaaaggctctctgcgtgctaatggtaacgtggctttacagatttttacccacttcaaatatggccgccaagctccgttctcttttaccgcctgatctgcggctacaattctggcttcatgcccgcctccaaaagtgcttcctctcgaggggttgtggttcttactgcgcaggcgcaaaagcaagtcctcttccgggcaaaatggcgatgggactaatgtgcggacgccgggagcttctgcgcttgctacagtccgggcgtcgggtaaggatgccccggggcagagcaccgggatgctgccctgacccagtgaaccaggccccaggacagctcgtgctaggggtatcagcagacgctgacctgctcaccgggacctgaatgtcatgacctcgggtcatgtgaggacgcgctagggttagtccccgacactatgggcccagcagcccggtgtcagcttctggaattggcttggctcctggcgagagcacctcggcctcgttctcagggccctccgatgtgggtctgcgataactgagatgcggggaacccaggttcgagcttcgctctgcaggcaccacccgctgcatgccttcgggctagcggtctgcgcgcggtgatagcaatgtcctcccctgtagtggccgagctgcctgcttcttggggagttagcataatgaatcccgtttgcacccacgcgaggacttctgctcccggtaaaggggctccatcatccttttacacgctcaggtccacagcgtcgcagggccctcgcaatggcttgggaaaccgctgaccacacggctcctattcccagcagccccgtgctgctgtcgcccacactacctcttccttgcggcttccggcccccgcagcctcagtacctctgctatctcttttgcagaagtccaggtaagaggcctttcgttcctgcaatattaggagtggtgtttcctggttggtttcatattttgttttgtttgggagcagggggaatatggagcagagttcttgtccacgctccacacagctctccaaaatgatagcatctctgcttaggatggattttcaattcagtggggaaatgattgaaagtacaacaggagagatgttatatttggttttctgagctgttttaaagaaaagcaattgtttcatgttaatatatggcaaaaatcatgatagtgatattcaaatggctgaagtttggaaaacagtgataaaagaaataacttcccagcatgaagggaagtcatggattcttactcaaagtaacttctcttcctaactattgataaaaatgagatgtcctttttaagcttgaaatctgcagacactaggctaacctggaagaacaagaagtagagagaacagaacccagtactggttattataaaaagatctcacttgctttgtgttcgctactgaataaatataatacaaggctttctttcacacaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtaaggggaatataccctggacatgggttagggatttaacctcatagatggcaattctttgaatggattcaggaagtagttgcagaagctctggggtcagaagagcagatgatttcaaatgagcaatagaggttcatgatacctagatgcactctgcctatatttcttaaagagcattataaaaccaccagatcatctgggattcaagaagtgtagatatttgaatacaaacatggggttagagtcaggggaccttattaacagtcatgaagctatcctggtttagaacagaggttcaggtcaggcacttaaacccctaaattgggaagccactagcattgcttttgtaaaggctagaactctgctttgaattatgtgtctttctgccacgttgctccatcaattatcttttctcccctgtgtcttcagcatttccctcctcactgccctaccccgaacatgtaaacatgctcaggcacacccatgtgttacctgggggaaggtttcttcccttcatccttagttccccttcacttactatcctatcttcttcctttgatggctgttatttattttgttgttgttaatttttgtggatacctagtaggtgtatatatttatgggctacatgagatgttttgatagaggcatgcaaggtgtaataatcacattatggagaatgagatatccatccccttaagcatttatcctttaagttacaaacaatccaattacacttttattttattttttattttatttatttttttaaacggagtcttgctctgtcacccaggctggagtgcagtggtgcagtctcagctcactgcaacctccacctcccaggttctagcgattctcatgtctcagcctctcaagtagctgggactacaggtgtgccaccacacctggctaatttttacgttctttatttaaaaatatgctattattactgactatagtcaccctgttgtgcaatcaatagtagatcttattctaacttttttttacccattaactattcccaaccctgactacccttcccagcctctggtaccttccttctactctctgcccatgatttcatttgttttgatttttagatctcacaaataagtgagaacatggcgatgttcgtctttctgtgcttgccttatttcacttaacatagtgatctccagttccatccacgttgtcacagatgactgggtttcattcttttgatagctgttacttaaaagactgctctgcatccaattagcctacttctttccatttactccctcagccgtctggcttttactcatatcacctcattcgaactgccagtaacataattgctaaatccactcctgtcagctttttgtttgaggaaacaaacaggattcctaatcatctgcttagagaagttaatgccatacttttgtgatgccaaattagagaactgagccttaaagcaactaattcattcccctgaccttatttctgggcctcttaggcatgagtcatagaatggacaaggcaagaataagaccctttcagtaaggacctaaaagccttcaaccttctagctgcagaactgctttaatttcactccaatcctagtttgtattttccaggtacagtctttgcccgctgcctgatttttcctctcatcgtgacgggccagcgagaggcagccaggatccacaatcacttgccagagatccagaagttttccagtcgaatcagagaggccaagttagcaggagaccatattgagtgtgagtcagttgcagaatgagcgtgggagaagtccacatttgcacttttccttacattctgctgggggaaaggaacaatgtaaatcagaagttgccacagtcgggaaagttctaaaggtttatctgtttcttagacctaatgctcccaaggagtggccagggttggttagaaatttcacaggccaggtagataatgaggatgttcacctccactgatgtaactgttaccccaaccattaatttcccctcacctcacagattacaaggcttcctcggagatggcactttaccagaaaaaacatggtattaaactctataaacctctcattctccctgtgactcaggtgagcaaaaacatttccttccttatttcatccagtacccatgaaatttcctctctgtgtttcatgtgtcccaggtcccccaaaaaacaggtggtggtggattatacatggctttcagtagtggggtgatgaaaatgttctctctggtaaagcatgctgacactgtttatcttgtgtaataggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgaggtaagcccagattggccaagtgccaggcctgcaaagtgaactggggttggagggtaaagtagttgtacagaatggtcatccttcacttgctggagaaagagttgatgggtaagagattagagacagattcactgaaactgacagctttcccgacttttccaccccacttcttttggcagctaggtgctgagacaggtgtgcaaagttctgaccttcagtggatgagaaatgtcatcagaatgatgcccctgataaccttgcccataaccatgcatttccccacggtatgtaatgccttatgggctggctccaaggccttctgcctagcctagccacctagcaagctgaccagggatacagcttctgagtcccttctctgtgttctcacccaggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggtaagggctcatcctctgtgaaaaaggactagggaaaggggtctaaaaataggaatgcaactgactctcttgcttctctttacacaggctggaaaaatgctgaaatgacgcgtcagctgcgagagcgtgaacaacgcatgcggaatcagttggagctagcagccaggggtaaatagtcctttcaggccaaattctgtcttttgtttcttcctttctgttcttcgttgaaatttgttttctcttctcccctcaggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactacatgctgcttcctgatacttattgaacagggaaatcagtgtgcacttcagaaaactgaagaatacccagcattttgggaggccgaggtgggtggatcacctgagatcaggagtttgagaccagcctggccaacatggggaaacgccatctctgctgttttacaaaaatagccacacgtggtggtgcacacctgtagtcccagctactcgggaggctgaggcaggagaattgcttgaatccgagaggcggaggttgcagtgagccaagatcgcaccaccgcactccagcctgggcaatagagggagactgtctcaaaaaaaaaagaaaactgaagaatagagtgagtcatgattgcttttgctggcccatggccttggaaaatataatgttttaacctggcattaagggtttaaacttccacccaggcgcagtggctcacgccagtaatcccagcacttttgggaggccaaggcgggcggatcacgaagtcagcagatcgagaccatcctggccaacatggtgaaaccccgtctctactaaaaaaaaaaaaaaaaaaattagccgggcatggcggcgggtgcctgtattcccagctacttgggaggctgaggcaggagaatggcgtgaacccaggaggcagagcttgcagtgagccgagattgcgccactgcactccagcctgggcaagagagtgagactccttctcaaaaaaaaaaaaaaaaaaaaaaaaaaaaaaacagtttaaacttccaacccatgcatgtgttgttctatgcacatttggattgcagtctagaggtgtggctgataagttgaatgttgagattgtatctaaatatagtaaccgcacttcttgatcccaagattactttaaaaatttcaagaagtagatgtgtgcaaattcttagtgataattaagaatgaaagttccaggctgggcaaagtggctcacacctataatctcagcactttgggaggctgaggtgggtagatcacttgagtccaggaatttgagaccagcctgggcaacatggcgagaccttgtctctgctaaaaagttagctgagcatggtggtgcttgtccatagtcccagctacctgggaggctgaggtgggaggatagcttaagcccaggaggttgaggctgcagtgatccaagatcatgctgctatactccagccttggctacagagcaagatcctgtctcaaaaaggaagttcatgtcatttttatgtaacaatccaacatttgactagagcagtttaagtgttctgttgtctgcctttgtgtagagcctggtttatcagccttcagcagctagcttgagagagaaaagatggatatactttcaagcataagattgattttagtctttgtgtttctaggctaatgggagctgtcctagagatagatactatataaaatgaagccactcagactttaggaacataaacttttattgtcatccagcacctgtgatagtttcatgtctctctaaaggagacaggaaattggagcattgtgggcccttttaaaagaaaagaggagtaggtaggcacacccaggtgcttctaaaacaaccaagcccaaacctgacatgctcctccccacagtcaccttcattgtcccctttaaaagtctggaacagtatgtagcaaaacaaataaattacttttcatttcaaaaagtaagttcaaaggttgaagctgcctaggccaggcttctggacaggtgcctccaaagaagtgagctttccttttcaacttccttagctctagccagtagaccagaaacccctgctttccacatcaggattccagatggtgtttagttagatttgggatcccgttgcttgggcatctctcctccatcttccaaatccatttctgcagcaactgacatacacaggacctggaggtaccttgtggcagaccctacaaagagaactttgagttggaattgagaagaggtcagctgggctgagttcaagtgtcactgaatggaact

SEQ ID NO: 42 - DNA, 2641 bp, Homo sapiens
ctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggtgagtgacccccggcccggggcccacccgcaccttccgctgcgctcgccccctcggggctgccagtggcgctctcctgctctcagcctccgccaggtttcccatcctaggcggaggcgggcaggggcgactgctgtgggtccagcctcccgcgccgcgcgtctcttgggagggcagccggccggtgctcctcgtttccgcctgcacctccccttctctgcctcgctcgcctctgaccgcgcgatctctatctgccactctcagaacttcctctctctcctcgctcctctctgctgagccaggtctccgcatatcctcctttccttcccagatacctccctcggacctctaacgggctctcagccagcgccccagggtacttcgagaggcagcagggccctggggacaagggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacacaagaaaaaaaaaaaaaaa

SEQ ID NO: 43 - DNA, 3060 bp, Homo sapiens
gccgggtttgggggttgggacctccggctgcaggtccgcctgggccagacgcgcgagcgcaagcagcgggttagtggtcgcgcgcccgacctccgcagtcccagccgagccgcgacccttccggccgtccccaccccacctcgccgccatgcgcctccgccgcctagcgctgttcccgggtgtggcgctgcttcttgccgcggcccgcctcgccgctgcctccgacgtgctagaactcacggacgacaacttcgagagtcgcatctccgacacgggctctgcgggcctcatgctcgtcgagttcttcgccccctggtgtggacactgcaagagacttgcacctgagtatgaagctgcagctaccagattaaaaggaatagtcccattagcaaaggttgattgcactgccaacactaacacctgtaataaatatggagtcagtggatatccaaccctgaagatatttagagatggtgaagaagcaggtgcttatgatggacctaggactgctgatggaattgtcagccacttgaagaagcaggcaggaccagcttcagtgcctctcaggactgaggaagaatttaagaaattcattagtgataaagatgcctctatagtaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcactgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagacccctttaaactgtcttattttccaccagattgagaaccagatgttctctacacactatcactgttcaatagagctttcttcagtgatggaaatgctctgtaatctacactgttcagtacaggtagctacggagcatctgaaatatggctagaaactacatttttgttttgattaatttaaatagccatacagttgctaccatactggtcacggcagctgtagactgactgggtccatagttcatcacctcaaaattctttcaaaatttattatctctttctctccttacatgtttatttcccaggcctaccctggtgattagaacagctgaagggcctttcttgttaggctgtccatgccctaaggatgggttcctgtttatccttgccacgcagctgagcttactgcatgtttatatctcccaaggactgttctctgctcagaaatgccctgtcaagggtgtggcatcacgcagtttcatccaagttgtttcaggaattgctgacactgctgggtgcagttctatcccctaaagcctagggtgtggccctttaacttccccttcagtagaactgggaaaggcagtaccattcctagttatgagtgaagcatccactttcttttgtaacaatgaggaacagaaaggataagactgaagagtgatcttttgtccaactaaaccatttatctccttttgtaggtaaattcaaatcctgcccagttatagttttcagtcactggagaattccaggtaggagccctactttaggtgatcctaggaactcctatgttcagaaaagaattttcttcctactatataattacagtatttagctgtcaattttaagatgaatttggtagagccttatagtaaagtatgtatcttggtcacacacaaagcttggaaaaagtaaaagatgtctaaaccataatcttgtaactcataacatctgggctggggcccggggatctaattgtttagagagccccaaaagtggctcagatgtaaagccagggttaagaaccatctgccttggaagatttaagggaaacatataaacttgtacaaaggacaaaaaaa

SEQ ID NO: 44 - DNA, 2021 bp, Homo sapiens
gcagggatttggcaacctcagagccgcgaggaggaggcggagtcgcggagagtttgagtatttccgtccaatcaaaaggagactgtaagaggaggaggaggaggagatgactggggagcgggagctggagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacgcctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaactccttctgcaaaaaaa

SEQ ID NO: 45 - DNA, 1751 bp, Homo sapiens
ggggcggggcgtcgcgggctcgtccgtgatgctctgggatcccgcgcttccgagactcgcagtctacgcgagctgcctgtttttttcctgcttggacgcgcatgagggccccgtccatggaccgcgcggccgtggcgagggtgggcgcggtagcgagcgccagcgtgtgcgccctggtggcgggggtggtgctggctcagtacatattcaccttgaagaggaagacggggcggaagaccaagatcatcgagatgatgccagaattccagaaaagttcagttcgaatcaagaaccctacaagagtagaagaaattatctgtggtcttatcaaaggaggagctgccaaacttcagataataacggactttgatatgacactcagtagattttcatataaagggaaaagatgcccaacatgtcataatatcattgacaactgtaagctggttacagatgaatgtagaaaaaagttattgcaactaaaggaaaaatattacgctattgaagttgatcctgttcttactgtagaagagaagtacccttatatggtggaatggtatactaaatcacatggtttgcttgttcagcaagctttaccaaaagctaaacttaaagaaattgtggcagaatctgacgttatgctcaaagaaggatatgagaatttctttgataagctccaacaacatagcatccccgtgttcatattttcggctggaatcggcgatgtactagaggaagttattcgtcaagctggtgtttatcatcccaatgtcaaagttgtgtccaattttatggattttgatgaaactggggtgctcaaaggatttaaaggagaactaattcatgtatttaacaaacatgatggtgccttgaggaatacagaatatttcaatcaactaaaagacaatagtaacataattcttctgggagactcccaaggagacttaagaatggcagatggagtggccaatgttgagcacattctgaaaattggatatctaaatgatagagtggatgagcttttagaaaagtacatggactcttatgatattgttttagtacaagatgaatcattagaagtagccaactctattttacagaagattctataaacaagcattctccaagaagacctctctcctgtgggtgcaattgaactgttcatccgttcatcttgctgagagacttatttataatatatccttactctcgaagtgttccctttgtataactgaagtattttcagatatggtgaatgcattgactggaagctccttttctccacctctctcaacacactcctcaccgtatcttttaacccatttaaaaaaaaaaaaaagctaaaattagaaaaataactccctacttttccaaagtgaattttgtagtttaatgttatcatgcagcttttgaggagtcttttacactgggaaagtttgtagaaattttaaaataagttttatgaaatggtgaaataatatgcatgattttaagtattgccatttttgtaatttgggttattatgctgatggtatcaccatctcttgaaattgtgttaggtttggttattttgtctggggaaaaaatatttactggaaaagactagcagttagtgttggaaaaacctggtggtgtttacaatgttgctaatcattacaaaacattctatattgaagcactgataataaatatgaaatgcaaaacctttttaattctatggtcaaaactaaaaaaaaaaaaaaaaaaaaaaa

SEQ ID NO: 46 - DNA, 1184 bp, Homo sapiens
gcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaattactctcctttggacatttattgatataaaaagaagattttggccaggcacggtggctcatgcctgtaatttcagcactttgggaggccgaggtgggcagatcacaaggtcaggagttcaagaccagcctggccagtatgttgaaaccccatctctattaaaaatacaaaaattagccaggcgtggtggtgcatgcctgtagacccagctactcaggaggctgaggcagaagaactgcttgagcccaggaggcagaggttgcagtgagcagagattgtgccactgcactccagcctaggcgacagagagagactccgtctcaaaaaaaaaaaaaagattttgtttcatttcatagcacaaatttagaggcattgagttgaccatttctagtttctatacctgaaggaacccattgattttaccagtttttatttctgtagattggatgtaaaaatcacagattcaataaattaataaactttgtgtaaaaaaaaaa

SEQ ID NO: 47 - DNA, 759 bp, Homo sapiens
gagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccatctccttggttaaaaaaaaa

SEQ ID NO: 48 - DNA, 2238 bp, Homo sapiens
gcctgcgcggagggagccgcgagacaggtgcgcatgcgcagtgcgcgtctgcgagaccgacttggacggagccgagctgaggctcggcttcctgctgatggtcagggttttggcaactccccggtgtgagaggggtagggagtgctcccggcggcgacggggccgagttcaccagccgccggggcagtagtcgaaggcccggcgcggcatgtcctgggtgccgcggtgcgggcagtgaacgcgcgccgggcgggatgggccggcgccgggcgccagagctgtaccgggctccgttcccgttgtacgcgcttcaggtcgaccccagcactgggctgctcatcgctgcgggcggaggaggcgccgccaagacaggcataaagaatggcgtgcactttctgcagctagagctgattaatgggcgcttgagtgcctccttgctgcactcccatgacacagagacacgggccaccatgaacttggcactggctggtgacatccttgctgcagggcaggatgcccactgtcagctcctgcgcttccaggcacatcaacagcagggcaacaaggcagagaaggccggttccaaggagcaggggcctcgacaaaggaagggagcagccccagcagagaagaaatgtggagcggaaacccagcacgaggggctagaactcagggtagagaatttgcaggcggtgcagacagactttagctccgatccactgcagaaagttgtgtgcttcaaccacgataataccctgcttgccactggaggaacagatggctacgtccgtgtctggaaggtgcccagcctggagaaggttctggagttcaaagcccacgaaggggagattgaagacctggctttagggcctgatggcaagttggtaaccgtgggccgggaccttaaggcctctgtgtggcagaaggatcagctggtgacacagctgcactggcaagaaaatggacccaccttttccagcacaccttaccgctaccaggcctgcaggtttgggcaggttccagaccagcctgctggcctgcgactcttcacagtgcaaattccccacaagcgcctgcgccagccccctccctgctacctcacagcctgggatggctccaacttcttgccccttcggaccaagtcctgtggccatgaagtcgtctcctgcctcgatgtcaggtgtgagacattgctgccttggctagtgaatccggcaccttcctaggcctgggcacagtcactggctctgttgccatctacatagctttctctctccagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacggcggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgcctctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatttaataaacaaggaaagagtgaactgagaccccaaaaaaaaaaaaaaaaaaaaaaaaaaaaaaaaaaaaaaaaaaaaaaaaa

SEQ ID NO: 49 - DNA, 3758 bp, Homo sapiens
acaggagggcgggctaaagaggtcgcggtcgcacgcgcagttggtccttagtactgcggccgtgtgggggcgtgaatactttttctcccgaaggaagattatttcaagtggaatatgccattgaggctatcaagcttggttctacagccattgggatccagacatcagagggtgtgtgcctagctgtggagaagagaattacttccccactgatggagcccagcagcattgagaaaattgtagagattgatgctcacataggttgtgccatgagtgggctaattgctgatgctaagactttaattgataaagccagagtggagacacagaaccactggttcacctacaatgagacaatgacagtggagagtgtgacccaagctgtgtccaatctggctttgcagtttggagaagaagatgcagatccaggtgccatgtctcgtccctttggagtagcattattatttggaggagttgatgagaaaggaccccagctgtttcatatggacccatctgggacctttgtacagtgtgatgctcgagcaattggctctgcttcagagggtgcccagagctccttgcaagaagtttaccacaagtctatgactttgaaagaagccatcaagtcttcactcatcatcctcaaacaagtaatggaggagaagctgaatgcaacaaacattgagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaatatttgttaatagactgttctcttctaatagtcttttttttttttttttttttaagagatgaggtctcactatattgcccaggctggtttcaaactcctgggttcaagtgatcttcccgcctctgcctcctgaagtgctaggattataggcgagagccactgtgcccagccattgtaatacagtcttttgtttgaaatgcaaatgttagtgggccaaaaggacagtgttattaatatccctattctatgaagatgtctgttctaaaactgttttagtgatgctctataacagaatcaactatatccattaatcccatggtgttgataaatgaactagtccagctcttcccagtggttaatagatgttaacagcactgtaaatccatttcggccctataatttctggagcaaacgtgtatttttgctgcttttcttataaggagatgctactaattgactatcagaagaacatgttttgaggtcctcctcaaaacattgatgggttggaatcagccatcaacagtgttgtaccagttcttgggtcttgatagacaatttggaaagagatttccttgtttacgaagtgaaggactaagaattaaattaatgaccttggcctcactggcaatcaattacaaatctctatatcagtaagagaattgtaaaattcagaagcagtttacattagactttggaatgaatgatgaactttccccattagagctgccatcatatgattggtggagattgtttaaagaatcattctatctcagcctcaaaaattaccacgggaagatggtatcagtatcactacttaacagatgaagaatctaatgctgtgtgcccatggacacacaaaattaagctgttgggacttgaacagctcaaattttcttgtttcagatcaccagctcttgagtaatagggaaatctggagatttgaaaagtacttgcactgtccacaacatggctaatccatatgtggatgatgcagaattgatttaattcactaacagggaccccataattatttgctgggctctgggtatattgatgtgtaggaagttgtactatatgttaataaattatgactatttggataggctgaattcatactaaatccatactgtagttcaacaaaaaacaacatgtttatatacatttggaaactgcaatgataggaaacatttggaagaaagggattttgccctagaataacacataaggaaagcagagaattagagtatattgttactgaatgttccagagacttctagtgattttaacacttattaagtatagcatgttgatggggagatttgtttctctaaagatcactttgttttattaaatcctaatagaaaatacccttgaaaatcctatctcatttattcctgtaacaaatttattgagcacctacctactatatgccaagaaatgtattagccatcaggcagagagctgttcaaatggtagatatgatctgtgctcctgtgaaacttctagtggggagagccaaacaataaacaatattcctttttaactctaggttaatgcagaaatggataaagcccatgttgcttttgggagaggtgagttgtgtctctgaatcacatgcatttcatagggggaaaaatgcccaaatactaaggagtagctcttagcctatgtccgttcgcctcagcttaagttgttttccctcccactggctgggcagcatatttgtgttttacctggtaaaacagtaaatttcgtaccttctataattggcattcttcaaagaggtagaactttgatttttttgtagaatattaaaacaagctttcttaggttaaagaagtgatcttactacgaacagcaatggtttcatgatgtgtaattgctttatgttatctttctgctatagaatgtttcctggagaaaggtacggtttttagtaataagataaatttactttagtcctgcaaataaggtgaaatcttatgtccagtatctcacaaaggagaactgacagtgccacttttatatttaatgtcaatctcattagacaaaaatgaaatatagttcctagggtttccaatttaaaaagtgaaataataaatatattcactcaaacattttctcagtgccatatgcaagttaccatgtcccagaagctgatacagtttgaagaaggaaatatataagtactgtaagcctgtgataactaaaagcaacatactaaaaagtgaaggtacagataattggaacaaatttaatagcgtttaaaagtgtatttggtaatttctccaggaggtggcactgttgagttgttttttcttttcagacagtaagacaatagaccattcatctttgtgtcacccaaacaaagaaatattcctttataaccccctttcctccccccacctaatcacatgctactggaactgactgtcttgtgatctactcccatagttggcatagatttaaaaataatcttttttaaattaatctgatagtagttatggaaaggaacaaattgttcaccaattttcatcagctttatcttttcagtccagtaactgagaacttaaaaagactattctagtgattttactatcctgctcagatggcattcaaaaacatttttcacttctcacgtcttggaaaaatttgtaaattcgttaagtctttttgtttgaaagttaatgtgactggaaatattttaatgtaaatatcgggttgggtgcattgtatcattttgctctacaatgactatatcctcatttgggtttatggccagtttataattaaaagtaatctttacttgctttgagtgtaaaaaaaaaaaaaa

SEQ ID NO: 50 - DNA, 925 bp, Homo sapiens
ttttttctgctaccgtgactaagatggaagcgtttttggggtcgcggtccggactttgggcggggggtccggccccaggacagttttaccgcattccgtccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatg

SEQ ID NO: 51 - DNA, 889 bp, Homo sapiens
gtgacagagcgctttacgacagttgctttgaggcagtaccggaggagaaagatggcggctaccttactagctgctcggggagccgggccagcaccggcttgggggccggaggcgttcactccagactgggaaagccgagaagtttccactgggaccactatcatggccgtgcagtttgacgggggcgtggttctgggggcggactccagaacaaccactgggtcctacatcgccaatcgagtgactgacaagctgacacctattcacgaccgcattttctgctgtcgctcaggctcagctgctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctttcttcttttatccacagctctcgctttggccatggagcgggatggctccagtggaggagtgatccgcctggcagccattgcagagtcaggggtagagcggcaagtacttttgggagaccagatacccaaattcgccgttgccactttaccacccgcctgaatcctgggattctagtatgcaataagagatgccctgtactgatgcaaaatttaataaagtttgtcacagagaatctttgtaaaaaaaaaaaaaaaaaa

SEQ ID NO: 52 - DNA, 1618 bp, Homo sapiens
gtggccaggggttggtctttggaatcggagaggcagattcgctgctccgcagcacggccggagctggtcgggtcaagagtcgggatttgtggggagaggttttccactggtcaagagaaggctttaagaaagacggtattaatctcccgttgcggctcccgcctggtcccatcttctgcccgctcctccaggaaatgaatctgctgccgaatattgagagtccagtgactcggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtccctgccaaaaaaaaaaaaaaaaaaaaaaaaaaaaaaaaaaaaaa

SEQ ID NO: 53 - DNA, 2644 bp, Homo sapiens
aaaatatctacagaagagctgaaaggaaggtcagcttctcagaagacactgtttctgtcatgtgtattggactttggggtttcattagcatggtctacttttaaccgttttgctgctgacatcatctccgttttggccatgaccatgagtggggagcgtgagtgcctcaagtatcggctagtgggctcccaggaggaattggcatcatggggtcatgagtatgtcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaaggtcaaaaaaaaaaaaaaaa

SEQ ID NO: 54 - DNA, 1362 bp, Homo sapiens
attggtgaagagcgacgggccaattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaaggtgaaagagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttttttccttttttgcttcaaa

SEQ ID NO: 55 - DNA, 1556 bp, Homo sapiens
ccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatgaaaaaaaaaaaaaaaaaa

SEQ ID NO: 56 - DNA, 1734 bp, Homo sapiens
aagtgccgcctcacagtcctgccagagacaggagacgccgggccgcccgcgccgtctgtcccaagagctcctcctggacatccgcttgactctccgtcgtctccaattggccgtcggggaacggaagccgaagcaaactagtgaacccggaagtgcttcgcggcggaggcccgggcaactcttttgaatggaatcgggctgattcatcgccggtttgcagacagagccgcgtcgggtgtgcgccgctgctgctgttgcctctgtcttcgcgtcaccacagaggcaagacaagggtccatatcgcggcatccggctcccgcccgtcttcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccaggggccacctacagatgctcctgcagtggacacagcagaacaagtctatatctcttccctggcactgttaaaaatgttaaaacatggccgtgctggagttccaatggaagttatgggtttgatgcttggagaatttgttgatgattataccgtcagagtgattgatgtgtttgctatgccacagtcaggaacaggtgtcagtgtggaggcagttgatccagtgttccaagctaaaatgttggatatgttgaagcagacaggaaggccggagatggttgttggttggtatcacagtcaccctggctttggttgttggctttctggtgtggatatcaacactcagcagagctttgaagccttgtcggagagagctgtggcagtggttgtggatcccattcagagtgtaaaaggaaaggttgttattgatgccttcagattgatcaatgctaatatgatggtcttaggacatgaaccaagacaaacaacttcgaatctgggtcacttaaacaagccatctatccaggcattaattcatggactaaacagacattattactccattactattaactatcggaaaaatgaactggaacagaagatgttgctaaatttgcataagaagagttggatggaaggtttgacacttcaggactacagtgaacattgtaaacacaatgaatcagtggtaaaagagatgttggaattagccaagaattacaataaggctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgctattaatgatgccttcagtgtatattcctctgttgttcctaatgctcaaaatcaagggacctctgaaggtgtacttggctaaatgtaagacatctggcatcatttgcagcactgtaacaccttcagtctcagttgtgcaattacttctgtttctttagtcagggtctttgcagattctaaagttatacatgaatacatcaaagtggacaaattttgttaagatcccatttaatatttgaaaaaatcagtagcacaaatatattttgattgtcacttacaaaataaaatacatttacagtctaaaaaaaaaaaaaaaaaa

SEQ ID NO: 57 - DNA, 6992 bp, Homo sapiens
actacttccggcttccccgccccgccccgtccccgggcgtctccattttggtctcaggtgtggactcggcaagaaccagcgcaagagggaagcagagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttacttcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccgggtacgtagtcactcagcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttagaacatctctgctttggagaaagacccagagatcaggcagaggtgcagattcaatcattactcataacctttgagagatggcaaatgggaggagtgttagtctttgttttggaattggaccattcttgcaaccaaaaggacttagagcagtttgctcataaagacatcctttattataaaaggaagtatttaaaggatgatagagaccatcagatagaagcagggaaggtagataacttttaggaccttgatgtgaggaaaagataaaatttaaacaataaatttgccacttagattttctagcagcaaagtccgaaaagatagttatatacaaaattctgttttctgaaaacaaaattgtgattcaccttcagaattggccattttttttgtgagtttccttgcatcaaggacactgagaaacacagtcattgtcttaggtgttctatgggaggaagtgaatagagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtgacctgttcctccttttttaaatagcagctttattgagatataatttacatacccataatttacatacctgtttaaagtatacaattcagtggatttagtatgttcacagtgttgcacatccaccaccatttctaattcctgaacattttcaccacctcaaaaagaaaccacacacccattggcatgactccccattcccttgctcccagccccaggcaaccactaacatctgtctctaaagattttttttttttttctggacagttctcataagtggaatcactcagtattatggccttttgtgtctggcttctttcatttcatgtgatgttttcaagattcattcatgctgtagcatgtatccatggtatggatatatcacattttgcttatccttttatcagttgatggacagttgggttgtttctacaaaaaggctattatgagtaatgcagccaagaacatttgtgtaccagtttttgagttttcagttgtttgagtttcagatgttttcagttcatttgggtatataccaaggagtggaattgctggttcacatggtagctctatattctactttgtgaggaattgtcagactgttttccacggaagctgcaccattttacatttccactggtaatttatgagggttccagtttccccacatcttcaccaactcttgttatttttcatgcttatggccatcctagttagcgtgaagtagcatctcattgtggtcttctcttccattttttaaaaaagaattttgacctacaccaagcaaggcagagaccagagtcagtcccccttggggagcaatctgtggttttgataatcaccaccttgggatgaacatggctggtgagctgcagagcagttgatttgacttttggggatggttctaggctggatgtgatacagggcaggttttgtctctagagaaagttctcatgaccttcaggtctaatgagattcagatcatcactttggtttggtttgaaatttctttgtttatccagtgaattacaagtagaataaagatctggttctaaattgtcttttggtggtgaagtgccatagaccatttcggaccatttctatgatgtaccagcagcccccacatcacacctcctcttccttggcttgtctcttccccaattcttagagttagcagtgtttcttactgcattcatctcctcagtcataagtgtctgtcaacctccgttgtgaagtcatgagtctcttgagactgaaactccaagaatgtattgtgctcacagtggcgatggtgttcctgtgctggatggtcagtggttgttgacatgtagttagaaaataggtagcaagttccacgcagcctcactctttggaacctagtttctcctatggcctccctttctactgttgttaataacattctattaatgatccatgcctctcttcacaggaggaatattagaatctatggagcagttagtattctttgtcacctaaatttgtctacttctgtacatttccaataaggcaccaccagggcaagggaagattccccacatgtatatccccagctgtttctgtcataaaacttgcatgtgtataaaccactattgactttttgcaccaaaggagatattcaaggacagacatccaagtccccagccctttattgcccttgggataccacaaggcacagatacaggcagctgctgtgtggctctggagttcctaatccccagattgtagcaatgatgatgtgatcctgctgctctctggaccgtaacctttttggttacaaaaggtaaatttctgtttactgcatctgaaccccaggactaatgcgtcactgcattaaccccaggacacatggaccaagtcactgcggccgtacttggccctgaatctgtcctggagggtgggtcaaaaggcaagggtggcaggtaggatggtaggcagtgaggggtggcaaggcctagctgactgaggacagacccagcaacaatgacaggaggtttgaacacctcacgagtggtagtgcccatgggaggtgcgaagtggaaggcccagcccttgcttggaggaacgtgaggctgatggtgcagtgcaatagaggtcactggatgcccatttgaacagctgcgttccagatgagccacctaaggtggatgttgtgagagtcacagtgggtttagagggacaaggtagtgagaggatgctgctgacgcattagtcctgggattcagctgcagtaaacagaaatttaccttttgtaaccaaaaaggtaatggtccagagagcagcaggatcacatcatcattgctacaatctggggattaggaactccagagccacacagcagctgcctatatctgcaccaaaaagtagatgtccttcacactgccatctggacaccactcagctagctcatccaagttcaaggctcaattgaatgcgtctggttgttggaacctacatggcctctcaaatggtactggcatggaatattggggagatgtctttattccctcttcccacctttcctggaaggtgcactgggacagaggtctagtgagccaatcttctgtgttgtctacgccatggaccatgatataaatgggtaccacagccttgcatgcctgagcctaaccatctcctgagatgcttgctctaagtacacattagtacatgctgggccccaatctagatctcaagggaacggccttcagatccatttttgacaagttccttttgtgagtcctatgatcatgcaagtttgagaactgagaagggaggggaagacctacctccttgttactcagaccaccagcaacagcagcatcacctgggaacctgttacacatgcagaatctcaagccccaccccagacattgaatgagaatctgcattttaacaagttctccatgagatttgtgtaaacttaaagtgagagaagctcacatggactatgtctttttcctttacgtgaatatcgagtacaaagaattgagccagtcagtcctcttggttaatggcacattatgattaatgcatgcatgaactctgattcgaagttttcgttgattttacccccagtatccactccattcctttgcccccatgggtcacttagatgtgtttcatgttatctttaaaaatgcagcacctttatagcatacattatatcttcaaaccataaccataatgaggtgttatccccatttcctgtaccagaaaaggaaggattgggaaggtccagtaatttgctcagggtcaagcaggagtctcagactcagtcaagcgtggttactcacagccctccctttctcagtgtgtggccttcctcatccacaaaatgagcatcacccctacctgcaggattcttgcaagatccaaccaaataatgtgtcttattaacagagagttggggctcggtgggtgcttgctgcaattgttactaaagtcatatgggtagataagggtgggactcaaggacaagagaggaaccttggaatatcccccagtgcaggaaacaagcatttatcaggtgcacacagcgtgctaggcttctcctcatcgcatgtagtacccctgacaaccccaaggtaaacacagctagtggcattagttgagatgctgcacctaccccctggggtggcagaaccgtgattggaacccaggtcagtgctcttttcagtagaactgctgtacccagacctcacatcctctctaggtgaggtgcatgggtccctgggcaaaacccattccagaagctgggaaaccacgtcaggacttgtgtgagaaaggagtgatgcttcataatccccaggatggtcttaaggctcctcagtcagtcctatttgcacagcgtgcctcatgctcctgagtacctccacctgcagccacagtgcccagagcacctggttaggaggagcatctgaaaccacctgcacaacctccattccacagaggaagaaacaggctcaagaaacccatatgtgatggggagctcctaacaggcttccctgggccacaggaatgggctcgggctctctgctgggctctgtcacctggctccatgtgctgctcacctcggccttctgagtttagtaggatggcagctagtcttccctattgacaggtgaaaaagcaggtccacagctgttgagtgactttcccaaggccacacagaccacaaatcctggctccaagtccagggcgtttccagtaagcactgtccaaatcagtcatggaggtccctgagtgacaaaaatatgcaggaccccttctttccccctcccagttcccgcagctaggctgagtgttaagaggaaggtgccatacaggttcagcaccctggtcagcgcccagcctccctaaagccgctggaggaggcctttggagccagctcaggtcagtgtctgctgcttccttacccaggatggcccactcttggggacagacaggcatcctgagaggagggggcctggacctaggtgtcttgccacccaatacagagccctgccctctccctctccttcagaaggaagtatgggagcagttccatcctcaaggtttcttggttcccaggacagaaatttgagtgagaagcatgtgaagagagggatggcccaggggcccttggccatggtggccttggacaagtttggctttccccatctgtaaaatgtagataaggatggacccacctccccaagatcctgcctatctgtgagagtccatgactaagtgggccatgggctggactgagttcagtgctcccccaacctgccctcctcctctcccccacagagcttcccaatttacatgtaaaccttgggcatcaaagtgacagctgatagcccaggtttgcccacaaatgtgctctgactggcgtgcatgttattaaatttgataagatgcatgatggcaaaaaaaaaaaa

SEQ ID NO: 58 - DNA, 906 bp, Homo sapiens
gtgcgctgctgcgcaggcgcggtggtcggacgacagaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattctggaacggatgctctctcttgtgtatgtgaacaaagtgaacataaatgaagagtctccccttccaaggctgaaaactcagcttttgaaagtgaaatgtttgttcatcggggccagagcagggttgtcctctgagcgcatcacttagtgacgaggaatccaacagctcaaggcagagtgtggatcaccggctcccgaaaacagcagtcagcccttctttctcctgtgtgacagcagtgggcagctgaaagagggaagaatgtgggattcagtcatcaaacccagttctgagtcctggttccacagcttgggtactgatggcaatcttggccaagttgtctctctactctgaactttc

SEQ ID NO: 59 - DNA, 1201 bp, Homo sapiens
ccagatttggctttatatagcggacccgtaaggccgaccggcctctaccggcgggatttgatggcgtgatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactgacaaaaaaaaaaa

SEQ ID NO: 60 - DNA, 866 bp, Homo sapiens
tcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaataaaaaaaaaaaaaaaaaaaaaaaaaaaaaa

SEQ ID NO: 61 - DNA, 1017 bp, Homo sapiens
ctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaatgtgcaattctgttgtgtgttctgtgaaaggatcctggccatattcaagtccttggacctcaagccacttaaagcttcgatgggagtagctggtaacaaccccgtcatcctctgattggatgccagtatttcctggcagatccaagtccaagcttcatagcattcattgcctgtgcttgccacaccttggttgatgtgctgtggtgcagtagccccatttggaggggagggtttggttgatgttggggtttgaatttagagccttggttaagcagggtgcagtgctcctgtgttccaggaggccccctgctattcagtgattctgttctgtactagaaattttatcagcattgatgcgtcatgaaggaatgacaggctttggtgtgatggttgagattaaatttagacttaactgtt

SEQ ID NO: 62 - DNA, 579 bp, Homo sapiens
tctttcttttcgccatcttttgtctttccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcacctaagcaaaagattgtgaagcctgtgaaagtttcagctccccgagttggtggaaaacgctaaactggcagattagatttttaaataaagattggattataactctagaaaaaaaaaaaaaaaaa

SEQ ID NO: 63 - DNA, 801 bp, Homo sapiens
tggcgacccggaagttgtacttgcaactgcggctttccttctcccacaatccttcgcgctcttcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaagtaagttctccatcccataaagccatttaaattcattagaaaaatgtccttacctcttaaaatgtgaattcatctgttaagctaggggtgacacacgtcattgtaccctttttaaattgttggtgtgggaagatgctaaagaatgcaaaactgatccatatctgggatgtaaaaaggttgtggaaaatagaatgcccagacccgtctacaaaaggtttttagagttgaaatatgaaatgtgatgtgggtatggaaattgactgttacttcctttacagatctacagacagtcaatgtggatgagaactaatcgctgatcgtcagatcaaataaagttataaaattgccttcaaaaaaaaaaaaaaaaa

SEQ ID NO: 64 - DNA, 1586 bp, Homo sapiens
gcgccccgcaggaagtgcttccctgggcggaagcttctgagcgtgatatagcggaagtgccttctcttccggtctttctggtctcggccgcagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttttaaaaaatacatatctggttttggtaaggtatttttaatcaattaggcttgtagtatcagtgaaatactgtaggtttagggactgggctagcttcatatcagatttacttgttaagtgactgttttggaatgtttacttttggactgggtttgtaacacggttaaaggcaatgagaaacaagcagaattccaggagtccttgaagcagagggcactggaagacaatatagcagattaaaatagcacagctcatgtggcataggtgggtattttagatgtttgagtaaatttgaaagagtatgatgtttaaattacctttagcaacatgttcatctgctatgctgtcatgactagggggatgattattagtcacatagagcttgggagtaccactggaaacgtatgggtaggagtttaggtggcttctgtttttcaaaagatgatcttatcctagtatctgtaatgctcacttggcacacctgacttgtgggctgtgtgtaaggtggctagctaagtgaaaaaagcctgctaggtgtgagtcaacttaagaatatgtaaataggtttgagaaaaagtagggcttgggtgcaagtaaagattgagcaggaaataaaggaaaatcaagtataatccctgagatttgtagactaaaggcaatgatgtgggactacttggtcgaatttttttagccctcaacttggtaattgggtgtttctgtgttaaagcactgaaacttgctgtcgtgccttcctagttttcgtggtttattgacagggttgggggttttttttgtttttttaaaatgaagggacaaagtcaactggactgctgagtgagagggcaggggcagttgaagggaacatgaattgctggaacagctacataaaatagtgatgtagccaagtcatgctatttaaattataattctccactgtgtttagaataacatctgaggttcttaacctggccttggaagggtatcacttttacttgtaacctggaatggctttataatgtgctagctaattgctactctcatcttgtattttaactcctaatttacccttcaggtctcagcttcagaacattcacttataaagaaaccctgctgattaaatctctcttgggcttcctcccaaaaaaaaaaaaaaaa

SEQ ID NO: 65 - DNA, 439 bp, Homo sapiens
gccttctaagctcgttcttccgccagcttccctcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaaaaaaaaaaaaaaaaaaa

SEQ ID NO: 66 - DNA, 11689 bp, Homo sapiens
caagtatttttcagtaaagcttgtgttttggtttgtttgttttgttttttgatcctctcacctcagcctccagagtagctgggactgctggtgtgggccaccatgcctggctaattttgtttatttttatttgtagacatggggtcttgctatgttgcccaggctggtttcaaactcctgggctcaagcgatctgcccacctcagcctcccaaagttctgagattactggcatgagccaccgcacctggctggtaaagctgttttaaaaataagtttaaggctagatgtagtggcataggcctgtaattccaacactactaccatgaactgctcatacacgtctatcctccttagtaatctgggacaggatgctggggacgtgtgtctcagttctctcttcaaagactcatctcccattcccacacttacagaactagaaccatgtactctgtgatttcatttattatatgctaaagcggtttttacaaaacaacagaggaaagatcattcaatatattatagtaagaatgtcggttagctaacatttggggggaaatataatttttttctatttattctatttatctttatcaaccccaagttaataaaaaattaaatatatgttattaaatagaattgagtatctaatagatctttgaactgatagcagctttctaagctttgaaggaacaagaagagattacaagagaaaagatcaacagatttggctatataaaatcctgaaagtttgtacactgaaaagtacaaccaaaaagaaaataaccaattggtatgacaaaggattaatgtctatattttataaagcattcatggaaatctacccaaaaaacatgtccccaaagataaatggccagagatacttcacacaagaggaaatggaatgagtaaacaagcatgtggcaaaatattcaacctcactagtggctttttttttttttgagatggagtttcactctgtcacccaggttggagtgcagtggcacgatctcagctcactgcaacctctgcctccagggttcaagcgattctcctgcctcagcctcccgagtagctgggattacaggtgcatgccaccacgccttgctaattttttgtatttttagtagagatggggtttcaccatgttggccaggctggtctcgaacttttgacctcaagtgatccgcctgccttggcctcccaaagtgctgggattacagtcatgagccactgcacccggcctagttgagattttttagtgtaaattaaaataattacattagcaaaagttaaaaataggtgattaccaggctggcacgagtatagtaaaattgcaagaatcctccgagaaaggctttttggcaatacacatatgctactacaaaaggattcagactctttgacacagtgctctctttctaagggttactgccaaccactcccctgaattaatcacagatgcaccacttctcccacatctgagtctccagcccagatcatgcgcctgagctcaggactgggtctataagatatctccaggctgatgttcccccgcaccctcagccctgtgtctcagactcatctcctcatcttctcctcaagcacactcctctgcctcctccttgttccggtgaatgcatcactgagtcaccaagccagaaacctgggagtcatcctaattacctcgttgtccctcacccctgcacattcatcatttcccagtcagatcctgccaatactccatctgcaatgtcttttgagtctttgagccccctcctcctcagccccagagtcacaaatctaggtctcagcagccttcagtttcttgcttgtattgttgacagagacctgacccatgtcctccaagccactcacatttccttcaaaccattctacgtggaggagtttgagttatctttttaaagcacaacactgattctgtcctccttaaaatctttcaacagctctccattgtctacccacaggctaaagtccaagatcctaaagatttagctgccctctgtattacaacccgcttcaccaccatttttttctccgataagcttctcctagctttccctccccacccccgcagcctgcttctcatattattatttgttccttgagagcaagaactagatcttaataatctctgcatcctcagttcataatgcagagcttgacacagagtaagcactcaataagtgttggttgaaggaatagatttattctaaggaaaatattcaactgaaggaaaaagctgttcactgtagcaacacgcataatagagaaaaagtacagaaaactaaatgtccaacaacagagaacttgtattaattgtgggacatccacttaatggaatatgatacagctgttaaagtagtaattatgaggattatgcagcaacttggaaagtgtttctaatataataaaaacagaatacaaaatggtctgtatgctaggactaaaattatgtaaaagtatgcatgcacacaagccgatcagaaagagaacaggaagaggaacaaatgaatacagatgatgtgtttagggtgtttggggaggtactgtttgcgatttacttagctctttccaaatttcctttattgttgttagaatgtcatttgtgcataaatacaaattgagagagagaaatatactgaaaaagatgctttgatttcctcaagtcctttgataacctatggcataaaaacaaaccactcacctgggaggcaagagacaagtcccctcatccccaaacgggctgtgtgatcttgattaagtgagatctgcagctctaaccagccatttctcctatcctctctagctggaaagcacatggttatccccccactcccacagcaacttctccaccatttctgttaattgtaccaccatcttcccagtgctctcagattaaaaacctcagaaccaacttccattatctcatcaccttcaccttctctctactcctcacctccaattaatcgatcctttccaataatcacttataacatgctttattgtggattgtatcccagttttagacaaggaggagttcctgccctcttagttaatactgtctgcttggttaatactgtctgcttgagaagagccaacaatgtttccctctcttgctcctctgcagactgctgaggggtaaagtggatggtacagatagagacttgtgaaatggaacctcatgagttaggagcttgatctcatggtgggaagaattcaggcacaggctggatgctctcagggatagtacagtaggacttggcacaataagtgggatgctgactccgtttattcattcaacaagtatttatcaagtgctggacacagtgccgagctctctgttcagtggcaaggggcctgcccagatgaattagggcaggctccatcctggaggtgctcagtttggtggaggccaggtaactaaatttgtccttgctacctaatgtgctgtgtgccctcaccaagtttgaacacaagcctctggggcaagaatgagggatttaccctgactgaggggaccacgagcccacagaaccagagggacttgaactgtgcatttccaaggctgaggtgtgggattaggtggtacccaggaagggggtttggctgtttgtggcagttccaagctaaggaatcgagtccacaagcagtcttgaaagagctgactctagccaggcgcagtggctcaggcctgtaatcccagcactttgggaggtcgaggcgggcggatcgcttgagtccaggagtttgagaccagcctaggtaacatggcgaaaccccgtctctacaaaaaaataaaactacaaaaaattagttgggtgcagtggcgtgcgcctgttgtcccagctactcgtgggggctgaagtgagaggatcgcttgagcccgggctgtctgtcgaggctgcagtgagccatgcactacagcctgggtgacagagtgagaccctgtctcccaaacaaacaaacaaaaagagctgactccctcggaacaaactagcttggtggggcttgagctttgaagtttgggattggggagagagagcaatggagccagataaagttcagacctgctcccttacggcaggaaacagagggccaagggcagtttcgaagcaggatcagatctacattttagttagatataaccagacgatttctaatatcctctctcctccctgagtctctataagtgccaaatgcgttgtacaggaagcaagggggaggatgtcagagttcaagcagagaagcaagagggggttaaaaacgttgttggctcttcccaactcagtatgggctgcctggctggctcaagggaacacaaaaaagggacagacaaaatacgtttaagaaataacattaaatatttattaaaatgtattctattgattatatacaagttctttgttttgttttgttttgttttgtttttgagacggagtctcgctctgtcgcccaggctggagtgcagtggcgcgatctcggctcactgcaagctccacctccggggttcacgccattctcctgcctcagcttcccgagtagctgggactacaggcgcccgccactatgcccggctaatttttttgtatttttttttagtatagacggggtttcactgtgttagccaggatggtctcgatctcctgacctcatgatccgcccgcctcggcctcccaaagtgctgggattacaggcgtagaatcatctgtacgtgagactggaagtaagctcactttgaactctccttgaggccagggatgttgtgtagctcatctttgtattcccagcacctagcacagaataaggcacacaagaggcgctcagcaaatatgggaggaggaagggcggaaaaaggggagggaggaaatcgcccttaggagacaccctctttccgcggcggttcctcaactcgggacttctgacctcccaccagcagatggcaagaaagagtcccggcgcgccagcaaagggctgagctgggcggagcagctgaaaatccggcgcgcgcagtctccagccccaatttctacgcgcaccggaagacggaggtcctctttccttgcctaacgcagccatggtaagccgtttagttagcgagctcttaggacgtatccgcctccatcctcccccggccggggctgcccgaggtttcgggattcctactggggatggccgggcagaggcgaagggatcacggcctccgtggtaggccgggacgggctccagggcgaagggcgaacgctggcctagggttggggaggcgcagatctggtgctgctgttgggaaggcctcggtttctgacccggccatacgtcctgatcccgggagaagctgcttttcctcccgggccggagccgcggctgggccaggagctcagactgcgagcccgaggttggtgggcgctgggggtgcccggcggagaaaggttttctttgtcattgcctttttggcacggcctgactttaccatacgtggccggtaagcatctggacacagcattaaaaaggcttccttactctttttaaagtaaaattggtgtcagcttttggctttagtgtacgaaggagcagcacatgtgtttgtgcggatgtcagaatcttgttccatacgtgtcaaaaacagacggtaataaattgtgaaaactttagaaacacaggtagactcctggctcatttctgttgctgtgcgtttcactagtatggtgttcttgaaagaccctaacctctaagcagatacagtttcaaacagtaacatggaaacactttagcaaggttctgaaagatagtaatcagtaaacgttctgaaacatagtaaccaagaatattctctgttacaataagaaggcttgttgcagcttatggatctcacggtgtttgttaaataactgtgtttgtttctgttttatcggaacactatactttaatattgtccacattttgctgaagatgaaactaaactaagagtttagtttcacactaggttttataagctgttctgaaacctgattaacagcattgcaatctaaaactttcaggctcgtggtcccaagaagcatctgaagcgggtggcagctccaaagcattggatgctggataaattgaccggtgtgtttgtaagtatcttatataaatatttccgtggccactgtttttaagtgtctcccaggactcatttggggaccaggctaggggaggaatatctattcttggcttcctctgcccttgaaggagctatactatctagctgtcctccacttccaatcgatttaatatttttgtgcctcatttattccacataccacatagtacatttacatggactcaggattcatgttcttaatgatcctggtcctctgacagggaagatgctataaaactttaaggtatgaaatagttttggatgctttttacacctcctgtgtaaaagtccaagttgggtgtaatatggacggtcttggtgttcagttagtggatctggtggactaggaggtaggtttgagtgctttagtgaatcccaacagtgattatcatttttaacgttacaggctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatgggtaagaagttttaaatactctggagacgcatattgatggcagccctatggtatccaaatactgtcttgatcatttttctaacctttgtaatctgtcaagtctcagaaacaaagcctgaccttccctctgttttttacttaaataaaaaacatgcaaataatcatgaaacgcttttcaaaactaaatttcgattcacttttaaattttacatgcagtcatggggttttgaaatattgaagatctggccgtgatctttaatcttcagaatccttgttggattagaactgggaggcacatgggggttctttttgtttcgtagagagctatggttgttgctcggcatgaggtagtggggatcactgtatgtagtaaccggttactgcttgatttcagatgtcatcagcattgacaagacgggagagaatttccgtctgatctatgacaccaagggtcgctttgctgtacatcgtattacacctgaggaggccaaggtgagtgtggcaagcaagctgggtctttactcagtatagttactttgttctaagggcctgcattgagtacgagtgctgcttgcaatgaggtgggtattgattagttaaaatctcatacctggaaatatctagctaacaattcgatgagattctgtcttacatgtaactttttgtcatgttattaaaagtctggctgatagctgtagggcattgatggatacctaaaattggcccccatttgaagttaacttcctcagcagattttctttttttgtggtagaaatgaattccagttgaaccgcgacttcctggtgtctcttaagagtcaaggagaatgatttctgggaacttgtttattgggtacctgacgtaggagccctttgccatgtctccatttgtgggagtagctttactttggggaggggaaggtgtcgatggaggaaacagacagtccttgaggcactagtttgaggtttaaaaaaagattacagtctttgattatttaatccagtttgttttgatggttttacacaaaagtttagggctgtttggattattggctgtaaatgaaggttaatttaattgactgatgtggctcctaatttccttttgcacagccttgttaacagcagactggagggcacgtccagtgggatctgtgattatttgatttacttcaaggatatcagggagtagagatccaaaattgaaatgctatgtgaagtatttgttgattggatgaactggtaatgtaattgctgtttgtgagacaaaactcagtcgtgatgtacagggagccattaagataaagttgagttgaagggaagaattcccagggccccataaggcttaaagagcctgggaaactggagtggcatttacattggaggagtggagggcaatggtggatgttaggaggacgagcctagagaagggctttatgcaacatacacttgagggtggaaagaacgatcagcgtcacaattaatctgcagcagttagggaacccatggttcctgtatagggttaaaaagtacatgtgagatggattgaatgtggctaacccttgtatttttctagtacaagttgtgcaaagtgagaaagatctttgtgggcacaaaaggaatccctcatctggtgactcatgatgcccgcaccatccgctaccccgatcccctcatcaaggtgaatgataccattcagattgatttggagactggcaagattactgatttcatcaagttcgacactggtaagcatcctctgtgctacctgggcaccctctttaaggcctagatcattatgaattgcacagggtctgggtatctttattaaaaaccatctgctccaatcgcccaggtgtgtttatagccagaggcacaaatgctcagaatactcatttcttttctttaaattgtttgttttttatagaggagggtcttactgtgttgcccagactgttctcgaactgattataggtgtgagccaccaagcctggccacaaaatttcttacgagagtcccgggagtcctagcataggcagcagttccatatgaggaaattcaaatggggggaaaggaggaataaaatttgtttggacccatctctgagctgcttgtcatttgttatattgagttgaagcagattatttcttcctgcctaggtaacctgtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaaggtaagtctgggttttccttctctctagtctgaggaaatatgtaaatgcaggtggctgctgggattgtagcatccaggctcctggctggctctgctgaacctagtgcaaagcctcttctggataggactcacgcagagctgggctgagtcataatgattagccttaggtactactaaactttgactcacttgaataaatggtaggtgcctgctatgcacaataaacttctaagacattaattctgaagggcatacggtgagtttcataggacagccccagaaacccaagcagtgggtgcttttggtaaccagcatctgtgtcttgcaactgcctagctgatgccaagcactctcacaaacaggcttcagttctgttaagtgaggtgacaaatgtagcatgtgccaagccactatgagttggtgtgtggtgggttttgattctgcttgttttctcttccagggcaacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtggcaggattaatagcattttggttttgtgggttgtttttttttttaattcagtttcctgctattttactgtataacatgaacagtgattaagttctcaggcaggcttaggcagtctgttattggctgggcttagttagtggtgggaagtagaagataccagacttgggaaaggaacagcaactaaccaaggagtagaaagagccaagaaatcccggagtatttatctcccccgccttgacttggccaagaacttctctacacagtggacccctctgccctgttaagttcccttggctttctaaaaatctgccctcattttcttctccagtctgtattgcactagcccatccacaagcctggctcatctgtttttcccactcctgtgcccatcttgccaaacgcaggatgaaaatctccagttgccattaaaggtggtcataaatgggctgttgatgttgcaaagcattgcagttccttggacttagtgcccttattctccagctgccgctgcagtcctcaactctgtttttcagaggacagagatgtagaacataaacttgttcttgcttgtccaaatgtgtcgggtcatgtcaggcttgcttaccagtctcaggaagatgtgcccctgcttcatggggcctgctgttacacacctgttcctcaatccagtccctccagtctcagtgtcaattatcctaccttgtgatttcaaccttctctcaaccaactctcttgttcctgttaccctataaagcatgtcttcctgttaaaaacgaaaacctcccttgccacctatagcagggcttttcaactttgatactgttaacatttggggctacataatttgtgggcagctgtcctgtttattgtggaatgtttaacaacattcctagcctctatccactagatattcaccccccaccccctgagttgtaatacaaaaattacttcagacactgctaaatgccctctgagaagcaaagttgccctgtgttgagaggtactgccttgtagatgctgtatctcaggtcaccttcatttagcaccttgcacttaacttgctgtagaccactcaggcttaatcatcccaccatcacaggtttaggggagaaaatcagttgcgttttggacatctttaagataaacatgtgaagtcacttggcatatttagctgggaatgttaaatggtccctgtttcccaggtgtatggtttagcagtggataagaggcctgtagaggcactgtggcttagggcagtatctctacccctggcagcatcctggactttgagtcagcagactacttggtcttgccagagaaaatcagctaaaggaggcatgcccaggggtccctgaagcccagatttggtcccatagggcttctctgccattcatattgcagacgccaaagcatgactggctggggtcccattcactttttttttttttttttttttttttttttttttaaagacagcgtcttgctctgtcacccaggctggagtgcaatggttcagtcatagctcattgcagcttcaaactcctgggctcaagcgatcctccagccgcagcctcctgagtaactgggactatgggcacgcactgtgatgccaaattaatttaattaatttgtttctgtagagaaggtcttgctacattgcccacgccagtcttgaattcctgggctcaagtggtcctcccaccttggcctcccaaagtgctgggattacacgtgtgagccactgtacctgggccagaaaaggaatttctgcagggactgggcccccctgaatcagggatgggaaaggtgtgtaagtgggcttgccaggtatcttgctttaagaatggttctcttgtcaagagaatggagctcatccttgttctgttgaggccaggtcagaagtaaccttatggtgcccttcagaaacaggcaggtgagccgggcgtggtgactcacacctataatcccagcactgagagaggccaaagcaggtggatcgactgagcccaggagtt

SEQ ID NO: 67 - DNA, 646 bp, Homo sapiens
tctccttacgtcacttcctctccagcccctgcgtaatcgataaggaaacccggacgctgctgcccctttctttttttcaggcggccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattcccaggccagacttgggatcttccgcg

SEQ ID NO: 68 - DNA, 689 bp, Homo sapiens
aggcatcggcgcggtcagcctcgtggcgcgcccacgcccccacgccggctcttcccggggtccttccgtgcgcgttgatatgattggccggcgaatcgtggttctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagaaatgaagtgtctagcagtgagctggagattggatcacagccgaaggagtaaaggtgctgcaatgatgttagctgtggccactgtggatttttcgcaagaacattaataaactaaaaacttcatgtgtctggttgtttgaaaaaaaaaaaaaaaaaa

SEQ ID NO: 69 - DNA, 114836 bp, Homo sapiens
taaatctacaatagctatgagccaaccccctgcttttgcctgtttcaggggcctggtacccttcctaacttctgaccctcagcctctttctttctaggtcctatggtggtctccttttccattcatgactcttcccctttggctagcagacgtttaaacatttcccttaggtctctcctctgcttttgctgaggttctcaggcctctaggaaggcagaaggaggattcaggattggcagagagagcacctccatatctacctttttgtctgtagagcaggaggagtggcatctggaattgattcatggtcttagcaaccaccagctccttaaagggtctcaagttcctagactagcctgtgtgtgtgcatgtccagtgtgcggtggcatgtctccataactcagccttgcaaagaagcctcttgcgaccggcccgtacataggcctttcagcttggcaggcctcatcatcttcattcccacaataatttctacatttccaagtgctttgccagcatatttgatcctccaaacagtcttgtaagataaattgaattggtattatcttcattaggccaaagttaaggactagcaagtttagatgacttgacttgtccaagatcacacaggagtccagacctcttctgaaccactgctctttaaaggccaacatcctgtctttctatgcctccctacattctccgtcagcagagttctgaaagagaccccacccttcctgccgcaccacagactttggtttgaactctgcaatacctatctatgacctcctttgaatcctatgagatggttagaagaggcagcatcctggccttttggggtgggtgaaggattatttgcaaggctgttctaaccttctcatctccagcctgggtcaggtccactgactgcatgtgccctgttccttggggcctggcccagactggataatatcctaaggtgtgacaggagtaagtggggaaggaaggcatggaaaatggtgactcggagcaggctgtaggttctgtgttagcttgagtcccaggaaatacagccagctatgagaaggcagagattttattgaggatgccgcctgtggaatttaagcctatggctgcaccagttcagagccagagcattcaccactggtggggcccaggtattggaaaaccatttgccagacagatgatggtatgatgacatttgtttttgtttcttatctgtttcttccctccctatcacttttccctttcttgtctttctctcttggcccttctttctacctgcttatccttttgcttttcttcctctacaattctactctccttttcctgtctcttttccaatctatcctcattccctcctcctgcctcctctcttatcctatacttatggctgctcaacttctgtctattcctctttcctctctccttcccacctgcctgttcatcctatttctctctcctgccgctctatccccattttcctaccctgtccttgtcttctcgtgttgtccctctctcctcttcgcctttcccctatcacctcatccaatatatgtccctttcttcctctctgccccatgtcttgcagggatttgacccattccgattcggagtcctccctccacatgagtgaccgccagcgtgtggcccccaaacctcctcagatgagccgtgctgcagacgaggctctcaatgccatgacttccaatggcagccaccggctgatcgagggggtccacccagggtctctggtggagaaactgcctgacagccctgccctggccaagaaggcattactggcgctgaaccatgggctggacaaggcccacagcctgatggagctgagcccctcagccccacctggtggctctccacatttggattcttcccgttctcacagccccagctccccagacccagacacaccatctccagttggggacagccgagccctgcaagccagccgaaacacacgcattccccacctggctggcaagaaggctgtggctgaggaggataatggctctattggcgaggaaacagactccagcccaggccggaagaagtttcccctcaaaatctttaagaagcctcttaagaagtaggcaggatggggtggcagtaaagggacagcttgtccttccctgggtgttctgtctctccttccctcccttccttcaagataactggccccaagagtggggcatgggaagggctggtccaggggtctgggcactgtacatacctgccccctcatccttgggtccttcattattatttattaactgaccaccatggcctgcctgccctgcctccgtcccaaccatgggctgctgctgtcactccctctccacttcagtgcatgtcttagttgctgttccctcagctcccagctccacctctggggttcagcttctgtctctgctgtcccagttttgaggtttggtttcttgtttctgtctcttgctttcgggctcctccctcccaccactccccaacttcccctagcagttgcagggaagataggacgagtagcttctgacatgtgtgcctcagatctgttccaccccactcacagtggttctgtttgctccagactggggctagggcctaatctttgaagtttgttctttggtattgatgtgggtcagaaggagcctcatcctaatctcactcaggcctccagggatccatgggggagtgaaaccaattctcagagaacaacccaccagagacttttaaagagaggccaggcttgggaatgggttgggagaggcatctgttcattggagcatgagtggatgccagaactgtaggttataaggcagtcactttttctctctactcccacccacacctgcctccctcttacccctgctcccccacactgcaggaggatttgtctctaagaggtgctgccccaaagctccccaagcatcaatactcctagggctcaggacaagtggctcccctggccaggagagccacagccatgatacagggctcttatggagccctggagttgttgggcaaggatgctgtcattttttgaaccaaaagacaaacaggttaaaaggaaaaaaagtaatctgaatttcccaagtgcctacgctgcatattccccttgttagatcccattttcatgttactttgtagccttggccagaggctcaaaaaggacacaaccagtttggggaaggggtggctaaggaagatggtataggtgaaggcggctgtgtgaccactttcccccacccttcccaccctctagacaactctctcccttacctgtttttgctatggctgtaaaggtatttttcctctgccccactccctgccatacctttatcctgggatcctattttgggcctggggtgggtatacctggggctggtcttaggagggtgctaggctgcagactgccttgtactccctggacaccctcaaatggggttttctgtgttatttcataaaattctttgaagtccaataaagcatgtaggagattttaaccactgctggctttgactctcattgtgttctctgtgctgtggcatgatgggataaagagacaatctttcctttgcccagggaaaatgaaacttgaatgcacatgcccagaagctctgtgggcagggttaccagataaatgcaggatgaccagttaaatgtgaatttcagataaacagtttttaaagtataattttctctcatgcagtatctgggacacatttttatttgctaaattgggaaaccctatgtctgggtaaacttgaccctatctatcctataacttcacttacgacttttaaaaaacatatctatttaatttttctttctttttttttgttttttttgagacggcgtctcactctcttgcctaggctagggtgcaatggcgcgatcttggctcactgcaacctctgcctccagcgttcaagcgattcttctgcctcagcctcctgagtagctgggattacaggcgcgtgctaccatgcctggctactttttgtatttttagcagcgggggggtttcaccacgttggttaggctggtctcgaactcctgacctcgtgatctgcccgccttggcctcccatagtgctgggattacaggagtgaagcaccgcgctggcctactttttctattttttgtagaaatggggtctcactatgttgcccaggcttatctcaacacctggcctcacatgatgctcccgccttagcctcccaaaatgctgcaattacaggctcacttacgactttccatgatttttgaaattacttcacagggagcctgggcagcttctggagggcagtgagaaaccaacgaaaaggctttagggaaaagatgccacagatgaaatttcataaagatcgctttgggtagcccaaatcagaagcttctacaccagccttacatattacggttctcatctattcttattctccactctaagtcaccaagtccatcctacctccacaaggcaaataccctgtctctgccaccatccactgaagaaccctaaaagcaaatgggtactgaccctgccctgcttaaaattctctcagggctctgatttgcgtcaggataaaatccaaacgccatcggccttgcgcggttttcttccagttccagagtgtcagtcctctggccgatctaaaagccctggggctccaagctgcccacggctgtggagcctgggctggagcccacagcggacggcagtgttagtattattataataaatgtcagagcaagaaaaacgttcccgccggttaggttttgttatttcaaaaataaattaaccgcctttcctccggcggagacgcgcaggtgagagggcggcgcctgacccagcgggctctaggtgctacgccagggccccgagggtcccgaactcggcttgcccacacaaaacatggtagcaggagagcagcatttccgccgggcatgtccatatccaatggggcccatgggagaggcgtagtcttctgggtcttgcccagactcaacatggcggctacacgtcgcctgtcagtctgtgaagcctaccccgggcgtgggccgcagcgtcgagtaacgtcattcgaaccccgtcgcgcccctttgtgcgtcacgggtggcgggcgcgggaaggggatttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgaggtgagggggggacgaggtgggcgagaaggaaggtgaggggatgcgggctgccgccgccggagctgatgcccagaccgcccgcccgccttcgctgcttcccgcctttcccgcatttcccgccgcggccttccgccctgtcagcccgctcggccttctgtcttcagtcagcctgccccgaacctccttcgggccttcaggctgcgccccctcggctttgtcatcctgccgcctttcaaaaggataacacttaccccgtatcgagtagtgactgcgtacgccgagcacttgccaggcactattttattcctccctgcaagcctctgagagatgattagcttattacagatgaggaaactgacgctcagagcgaggtgtcgccgactgacccaaagtcacccataggtgacaatacggtttgatttgaaaaccgtggggttggtgagctgtcttaggcacagggtcggggggcagctaggaaagaaggagggggcctctctaccctccgtaggcacttgtcagtttactgatctcttttgtggggtgaggataggagtgtggcgtggaaaaaacagatcccagacagacagcaccctcgagttcctttcccttcatgggaagagatgctgaatcagagaagggtggctgagacatcttctgacaagatggggactgggaagagtcaggaactcgtattctttctcaacagttctttttcattagacttgccaagtgcccgctttgtgcccagccctttgcttggctttgtgagattgtaggaggagacagtccctgccttgggaacaggcttcatcgggttggaaaaacaagagcaacatacttttaacaaccgcatgagatacgtatgaacaagttttgagttgaacctacttgcctttgttaaagcaatacaatgatttcaaaattgtaggcacttagtaaatactggttaatcgactggttgtttctattttgtcctctaggctgtgaacatttcaaagatggagacttgtttgagacagagtcttgctctgtcacccaggatggaatgcagtggtgtaatcatagcttactgtaaccttgaagtcctgggctcaagcgatgctcttgcctcagcctctcaagtagctgggactataggcatgcaccaccatgagtggctaatttttaaaaatttctggtagtaaaggagtcttgctgtgtttcccagtctggccttgaattcctggcctcaaaccatcctcccttccttggcttcccaaagtgctgggaatacaagcaagatggagacttttctgttcacgtttagcacaggacctgacatgaacagattcttaaagaatgaatgaaaatagttgtatcaaaatgtaggacacgatgaatgctgtgaataagcaggtagttgatttggtttaactacagccaatgtccagattggtttaactacagacaagagttggaaaggtggacagtagtggcctttcttgtttttggtatcttgagaacatcattctgtgaattttcctagctcacattttagctgaccaaagagcaaaataacatagtgcacttttattgatccattcataagagtgagagctgagcatctatttttgtatttttatttttttacattattatttatttgtatttttttagagaaggagtctcgctatgttgcccaggcttgtcttgaactcctgggctcaagcattcttcccacttcagcctcccaaagtgcttggattacagtgctgggagccaccgcacctggcttgagcatctattttttaaatctttagatatgggagagatgtttaggatggtctatgataagtcagtaacaaagatgaattgaaaatgtatggacttagatgaccagaatgggtaaaattcaaccctgtgttgaattttgaacttttagagtctacttctaaatactttcgtttaaaaagtgctaccttggcctggcgtggcagggcatggtggctcacgcctgtaatcccagcactttgggaggctgaggtgggtggatcatttgaggtgtggagtttgagaccagctgggccaacatggtggaaccccgtctctactaaaaacacaaaagttagccggacggtagtggtttgcacctgtaatcccagctactcaggaggctgaggcaggagaatcgcttgagcctgggaggcagaggttgctgaaatcgtgccattgcactccagtctaggcgacagagtgacactctgtctcaaaaaaaaaaaaaaaaaaaaaaaccacaaagtgctagctataactagctctaaaaagcagagcttattttctcattccttcatagagcacaatttgatccagatggttcatgctgtagattctgccattgtagcattcagcaagacttaatatacaacatgtacttagatttgtttgtttctttttttttttatatttctatgtttctatattttaatgttttttaatatgcatagggtttttggttttctggactttttttgtacccccttatttttggcatgtcagtggaatagcagactaactcctacagtttttgttaattttctttgagatggggtcttgctctgtcatccaggctggagtgcagtggtgtgatctcagctcactgcagtgtctgcctcctgggttcaagagattctcctgcctcagcctcctcagtagctgggactacagatgtgtgccaccacgcctggctagtttttgttatttttaataacaagggcaactggaagttgactttgaagtacctactgaatatgctaatgtcttgctaaacactgtgagggcagtaatggagaaggcagctctatcttcaaagaacttaaaattgttagggatttaggaacaatccatatgaaaattattagatagaagagaatagtagatgagtttttttcatctgctatcttgagctatttttcctaatgggagagtatcattcctcaaggagattatggttaaaaaaataaacattgagaaccattgcagtaaatgacaaagtagctaactgagttgtaaactgttttggaatttagtgtagtattttcaaaactttggattgtaactcacagtaaaaaacaaaacattttacagacatgtgtatatatgtggatacacataaaatgatacaaaagtttacgaaataatgtctttgaaagcatccatttgcactctaatctttcttttattccagattctttccctatccctgcctccctccctcccttccttcctccctttcttcctccctcccttccttccctccctccttgcttccttccttcctttctccctcccttctttcctgccctcctccctccctcccctccctctccccctccctccgtcccttcctccttccttccttccttccttcctattccattcacagcctgctaatattattttacaactctgtggataccgtgctgttcaccgggattgcagtgatgagtaggcagacatggttccagcttccaaagatcctacaatcaattgagaaagatagacaaataaagaagtaatatgataaaatatgataaatactctgataggtaaagtataggcagtagaggccattcattcagttattcataaagcatttattcagcacctctttgtgctaggaaccgttgtaggcattagagattctgcagtgaacaaagctaaattacatttctcattgagttgacttcttggtgtgggtgggagtggtaagtgtatataagaaataagaagtaaacataataatcagttaatttcagatactgattaatgagatgatagtaaaacaggatcatgtgataaagatgaatgagaaaataaccttggattgggtagccaggaaaggcttctctgagaagccaacatttgagctgaaccctaaatagtattaagagctagtaatgtgagatctgtggcctgaacattctcggcagagggaattagaaagtttgtatcctgtggaaaaggcacgcatccttggtcttacaggattagggaagtcttcctgaagagagaagaatgaaagacagtttatagccaagaggaaatcacactagtatgctagaggattttttaattttattttttattttttgagacggagtcttgctctgttgcccaggctggagtgcagtggtgtgatcttggcttactgcaacctctgcttcccaggttcaggcaattctgcctcagcctcccgagtagctgggattacagcatacccagctaatttttttttttttttttttgtatttttagtagagatggggtttcaccatattggctagactggtctcgaactcctgacctcaggtgatccgcctgctttggcctcccaaagtgctaggaatacaggctgagccaccatgccctgctggctagaggattttaaaagaggaaaaggtcagtgtgagttaaaagtggttgaggcaggttttatggaggtgtgagatttggagggtgagtaggagttagatgtatggaaaggtggaagaggaacctttaggcagagtaaggtataagcaatgatgtggatatgggaatgggaagccctcttgggacttatatttcacagggaacagttgaagagatctggggccaaactaagaaaggctttgcttgagagaagaggataatgtaggcagtgagaagcagggattagtgatgtgataaaatcaacatctggcttgaaaaactaaccaagtggaatgacagaatagagaactgtgtgtcattggacctttagatctttagtctgcctcctattttcaagtgtgagttaagataattaccaatgcacttttttttttttgtcagtttcctgattgacttcagaacttctggcagttgtagaattttctttttgctaagttgctttccccccccactgcatgtataattgcagaacgctaatgttgctttgcagttacctgcctgcttagttatccaattgctagagcactgaggtttcagtcccagtgccagccagttaatttaccccatttcagagttaaatgctgcagatgtgagcctgatgagaaaattatcacaatggtgatcagaaagagaggggctaacatatcagtgtagaagaaaaagcaacttgttctagtgataatgggttaatagtgatgtcttattgttcatttattcttcatcaaatgtttgagaacttgccttgttctaggcactaaatttgagaatacagatgtgaatcagagggccaaataaatgtaaacatatttagcatgtttcttattggttacttcaggttgagtatcccttattcaaaatgcttgggcccagaagtgtttcggattttggatttgtttcagattttggaatattcgcattatacttactggttgggcatccctaatcagaaaatccaaaatctgaaatggtccaaggaacattttctttgaacattgtgttggcattgaaaaagttttggattttggagtgttttggattttggaattttggattaaggatactcagcctatagttacaatggattgtaggtgcacaaaagagacaaaaactaaatcagtgtgagacactaacatttattgagtgcctattgtgtatcacatactgtgatttttttttcccccataggagcagctttattttataacgaggtatagttgtaactatgccaaagttgttacaacaaaagcactttttaccttatctaattttattgtcacagtaaactgattaggcaagtaaaatagatataataattaacccctttctacaaatgaagatctgtgaaatgactgattgtgttttgtggcttgtctaaggttaaggctgtttggtggttggatatattcactattcctggtaagaataaataaaggtcggatgagctactatttgaggttaaactaagagtagtaagacttttttgtctagaaggacaaagatataatctaagtccaaaatcatgaaaaatattaggtaaaatatatagtatgtcagatggggtaagtgcaatggagaaaaagcacagaaggggaagggggataagaagagcaagggtcctatttggggcattgcaatttaaaatggaatcatcagggaaagccacattgagaaggtgatgacattgagcaaaagacctaaaggagatatatagcaagaaggccaagttgtcaaggtacaataggaaggaaggtgggagagttggaggtgaaattgggaagtgggtgcacaggacaagtggtataggattctgtggatttttttttttttttagttggagtttcattcttgttgtccaggctggaatgcaatggcgtgatctcagctcactgcaacctccgcctcctgggttcaaacaattctcctgccttagcctcccgaatagctgggattataggcccctgccaccatgcccagctaattttttgtatttttagtagagacggggtttcaccatattgatcaggctgatctcgaactcctgacctccagtgatccacacccccccccgctcccttggcctcccaaagtgctgggattacaggtgtgagccactaggcctggcctgtggattgttataacaattttgacttttattctggagatcataagccactattaggagttttgaaggaggtaatgatatgattctgagtttaacttttaaagggtaattttggctgccatgtgggatgggggaaaaatttaggaaattatccgtaaacgtctgtctgtatagaattcatactctttgaaggtgacatcagagaagacaatctcttcatgaatcttttgagggggcctcaatcttttctgtgaaatagcacttcatgttggtcaatttacatgttaattacatttgattctttgacattgtagtcttaataattgctaacatgaatttaataattgctaacatgatttgattctttagatggccgccaagaacgagtcatgtttgacaaaattacatctcgaatccagaagctttgttatggactcaatatggattttgttgatcctgtaagtaaatatggtttttatcttgggttccttctttcatgtgtttctttccatttgtctcttatccctggaccttcattcacctgatatactttggtattctggctatgcccttcgatataaaatttgaattcattgcttaaaacatttttttttccttaattttggttctgtcctgtgagttctcacttttcagagaactatgaatgtgagtaaagaggaaaatttgatattaacatttaatatcagatatttccttgagtaaattgttttattcattagtggaaaagcctaggccaggcgccgtggctcacgcctgtaatcccagcactttgggaggctgaggtgggcagatcacctgaggtcaggagttcaagaccagcctggccaacatggtgaaaccccgtctctactaaaaatgcaaaaattagccgggcctggtggtgggcgcctgtaatcccagctacttgggaggcaggagaatcacttgaacctgggaggcagaggttgcagtgagccgagatcgtgccactgcactccagcctgggcgacagagcgagactccctctcaaaaaaaaaaaaaaaagggaagcctagagtaaagcttgttttggaattgtggttatttaggtagggactggtttaaaatttgttttttgttatttatgtaaaaagatttaagtaatataaagtagatttcatggacaatatttaagtcaagaacaaactattcataaaccagttgctctgcttttctccttatcctttataacttctgtattctagactctcatcatcagttatctggactgttttctgtggtctctgcagtgtcctggacttcctctaatcttaccctcttcaaactcgtcttccacctgacttctaaaatgatcttccttaaatgagaatctctaagaactctttttttcaaatccacccatatttccgtctccttatttaggtatcttatccgcactgctaaggtatcttaggtatcttatccgtaaaacctgtgctcatctcatagctttaatcatatagtatggaaattaattatggatctttgtcctcccctagaattgaggatgggctgtgtatcttattcttgtgatatcctcagtgcttgacatgtatctaattagccacttgaccaaagtaagtttggtcaagagaaaatgattttatgtatcttgaaaatatgtttattgtaaattctcttttatattgaggacttaggcaataattagaatagtagaatgttagagttggaatgaacttaagagtccatcccatttcatctttggtttatagataagaaagttccaaagagagaggggagtgacttaagttagtgggagtgtagggagaagcacctaggtctcttgactcctacatgttctattgcctcatgcagtagtacattttagagcgcaagaatgttgcagcatcctcaaacttcctagggtagattctgttgaaaaactgtcggtgcacatctgtaatcccagcactttgggagactgaggtaggcagattgcttgggctcaggagtttgagaccagcctgggcaacatggtgaaactgcccaggtgcagtggctcaatcttggcccactgcagcctccacccctggggatcaaatgattcttgtgcctcagcctccctcagctgggattacaggcatgtgccaccacgctatttttttttttttttttttgtatttttagtagagacagggttttgctatgttggccaggctcgtcttgaactcctgacctcaagttatctgtccgccttggcctcccaaagtgctgggattacaggtgtgagccacactgtgcctgccctcaaccctgtttctacaaaaaaaaaaaaaaaaaaaaaattggttgggtgtggtggcgcataccagtagtcccagctacttggtggtgggaggatcgcttgagccctggaggttgaggttgctgtgagctgagattgtgccactgtactccagcacaggccacagaatgagaccctgtctcaaaaagaaaaaaagaaaaactgtgtgctgttagatctggcacagttagcacacagatggtattttattctgagttctaattgtttgccttattgctctagaaactatttagaagacttcactgctcttatactgaacacaccttatctgctggatctgggaagaaagtgatcaggagcaacttgggcttagctatattataattagaatagattgcagactgttaaaatagttacacacgtatgtgtctttttttgaggggagtatgcattgttcagctgggaaacacatttattttctgttggattaagcggtttcttaaagattcaataaataaaccactcacaacttagaatttgtttttcttaaaaatgtatgctaataccctgtgcattacctgtcttaaaaactggaacttataatgtggccttgaaaacagtgaaatgcagtgaggtttaatgggattggggccagaagacttgtataataatataaccttgggcaagtctcagtaacctgagcctcaggttcttcatgtaaaataggtatagtaataatcatctcacaaagtgattgtgaaatgtcagagattatcaaagttgataattacttatcaactttggttgagaatcatttgaacctcgggggcggaggttgcactttgtaatttgtgaagtgctaaagaaagttgtcattaaattatcataattcagccccagacctaatttatacttctgtctcctttaattggcctgattaaagtttgattcatttgcttttctgtacttaccttatgtggaatttgggaaaagtaagtatggagctggagccctgatcacttagggagaatctgaatgaaaaatggggaaacccttatatagaatcagtctgttgggagaatttgaatgaaaaatagggaaatatagaatcattagtatgttttcagctatttccctgtgagactaatcgatttaaaggctatacttagattttttttaatgacactttcattttatatgtagtatacattttctgatagttctgctggattatgcattctcattactaagtttcccactgcccaccattctgaaagataaattttcagagaagtaagttgtcttgttctttgtttgagacagggtctcattgtgtcgcccaggctggagtgcagtgccatgatcatagatagctcagtgcagtcttgacttcctcagcacaagcaatcctcccacctcagcttaccctgtagctgcaaccacagtcacttaccaccatgactggctaatttttttatttttagtagggatggggtctcattatattgctcaggtttgtcccaaactcctgggctcaagcgagcctcctaccttggcgtcccaaagtgttgggattacaggtgtgagccactgtgcccaacctgtcgtttttattgtgatgtgaatttgattgttttcttttttctttccttttttttttttttttttttgagacagggtctcactctgccacccaggctggagtgcagtggcataatcacagctcattgcagcctcagcttcccgagtagctgggatcacaggtgtgtaccaccacacccagctaattttttttattatctgtggagattgggggcggggcagggtggtcttcctagcttgcccaggctggtctcgaactcctggactcaagccattctcccacattggcttcccaaagtgctgtgattatgggtgtgagccacaacgcctggcttttttttttaatagtgtcgtgaactgctaagcttaagtgatctcctcacctcagccactgagtagctgggactataggcatgtactaccacacctggccatgatggttttcttaattactcttttaaggaagctattgtttcttgggaaagctcaagtaattcttggttttatttttgtaggctcagatcaccatgaaagtaatccaaggcttgtacagtggggtcaccacagtggaactagatactttggctgctgaaacagctgcaaccttgactactaagcaccctgactatgctatcctggcagccaggatcgctgtctctaacttgcacaaagaaacaaagaaagtgttcagtggtaagtctggggtgaaaaagtaaaaatttagtactctcagaaaagtaataagggtactagaaataaatcttgactgtttaaagaagcaaatatggctagatggggtggcttacacctcgaatcccagcaatttgggaggccaaggcaggcaaatcgcttgagtccaggagtttgagaccagcctgggcaatgtggcgaaaccccatctctacgttttaagaaaaatctaaaattataaaatagactaggtgcagtggctcacgcctgtaatcccagtgctttgggaggctgaggcaggtggatcgctgaggtcaggagtttgagaccagcctggccaacatggcgaaaccctttctctactaaaaatacaaaaaattagctgggcgtggtggtgggggcctgtaatcccagctactggggaggctgaggcaggagaattgcttgaacccgggaggcggaggttgcagtgagctgagactgtgccactgcactcctgcctgggcaacagagtgagactccgtctcataaataaataaataaataaataaatagcaaatatgtaaattagtgggaaagagcagactacaatttcgtatttctccatgctgcctatctgctgcataaaaaggttgatggatctttgttctttttttcattttctctttttaaaatttttttattttttttgagataaagttttgctcttatcgcctaggctggagtgcaatggtgtgatttcggctcactgcaacctccgcctcccgggttcaagtgattctcctgcctcagcctcccgagtagttgggactacaggctcccatcaccacgcccggctaattttttgtatttttagtagagacgggtttcaccgtgttagccaggatggtctcaatctcctgacctcgtgatccacccgcctcggcctcccaaagtcctgggattacaggcgtgagccaccgcgcccggcccaggaatctattttaaactacaagaacttataatcactttaactctagaagattgtttccttaaatgaggcattacatatttcttcaacatatatgtgtttattgagcactttatatgctaggcattgaggtgggttgagatgacaaaaagggttgagaaccactgttttcaactattacctaaagattgaattagctgttaagtggtcttgatatattttcattttttgttgtattttttagatgtgatggaagacctctataactacataaatccacataatggcaaacactctcccatggtggccaagtcaacattggatattgttctggccaataaagatgtatgtataacacttatctggtggaaattttttgagagtcttttttaataatgcacacattttagaaaatttaaacactgcaaaagatacaggtaaatactaattctgtttcctaccctgattcctgattttcctctctagaaacaactttatcattttaaaatgtatttttccagagctattttgtacatacgtgtgtgcatacatgtgtatgtgtgtacatacatatttttcttctcagtggtactgtactgtgcatacagttttcattgatactttcttcacttgtaagtatatcttgtttgttctatatcagcctttatgaatttacccttttttataacagttgtataacgttccattttgtagatatattgtcattgtatgtatgtgtaagaattcctttagtgatcaatatttgtttttcatcttttcactgcagtgaatattcttgtatggtaggtgttttgctcatagatgaatatatctgtaagataaatcccttcagtagaattgctgagccaatgtgtatatgaattcaaaattttgataggcattgccaaactgactcccaaaaaggttgctcaggtaaaattttacaagctcatgctcagcaacttaaaaattatccacttgtgtttgaacctgtttcttaactagatgccagaggacagaagggaaaagatgtagcctagccagcccttttacacacaggatttatttaccgtgtatatctggacagattagagaccagttttaactttaggtaatataatgattaggccgggcgcggtagctcacgcctgtaatcccagcactttgagaggctgaggcgggtggatcacggggtcaggagatccagaccatcctggctaacacggtgaaaccccgtctctactaaaaatacaaaaaattagccaggtgtgggagctggtgcctgtagtcccagctactcaggaggctgaggctagagaatggcgtgaacccgggaggcggagcttgcagtgagccgagattgggccactgcactccagcctgggcaacagagtgagactcagtctcaaaaaaaaaaaaaaaaaaaaagaatgattaattgactatctctctaaacatgtatctgatgttaaagagactaggagaaaactgagttgtttgtgtgttgttaatttgtgtaatctcgaagacaagttgaagacaaaaatacagcagcagcaacagcaaaacctgtgtctaaaaatatacctattgatagtcaagtatttcagttctctaatattcacactgggcccatacctgcctttggcaacaaagatgaccttaaaattttaagagaaaaggaaagcaagctttcgtataggtttttctagtccttagatatggatcattatgtagaaacactgtcagtattttgaaaacctggctccttttttttctctccaaaatgattatttgtacgttattgcttttattttcctctgaatgactttgtagcctacaaaaactctgtaacaaggaccagttatgctctaaaatcttactgttacaatagttctttgttggaaacttgttaaaggactatagattttgaagagcctcagaattaacataagcctgcttcctgtcattgtttattatatatactgttatatacagtttgaagtaggctagcttttaaaataaatatatatatatattagtaaatatgtggtaccaatacttttggattaatagccaatctaaaaacatgtttaaggatgataatatagtcccatttatgctcatgttttttccctctttcaaaacatactataaacataatagtaaaagtttggaaaatcacatttaatctcacaacatatatttatgtattatcttctagtgttttcatatacatgtttttaaacctaattaggatacttaatttatatgtattgtttcttttttttagaatgttagatggacttctattctacagtaataatgcttagtgttatctcattgtatcctgtgttgattttagttctggagtcagggccgagagataagagattttgtgaaaataagtaattattttaatttaattatgggttctttttcacccctatcagcgcctgaattctgctattatctatgaccgagatttctcttacaattacttcggctttaaggtaaataatgggtttcaagtatgtgggaatttatacttaaatcatgaaataaaggattttgtttatgttttggtgacagttatcaaggccataagttgtttggagttgagatggacctggggaattagtggggttaaggtagcagtggtggtttgaattaaggcaaaggtagcttatctatttgcagtttttgaattttccacatattacttctggattacctgaggagttatgcagataaattaccataagtatttcataacattctaagtatttttgcgttgataggcagtatagtatagtgtagtgactgagaacatgaatgtcagtgtccacctgaattccagtctctgctctatttcttattagcaagttatttaatctctctgtgcttgtttcctccattttagaatggggagaatataaaatttcaacaacaaatttaattaaaaaaaaattttttttttgagtctgtgtctcactgtgttgactaggctggagtgcagtggcgcgatcttggctcacttcaacctctgtctcctgagtataagcagttctcctgcctcagcctcctgagtgactgggactacaggcacacaccaccatgcccagctaatgtttgtatttttagtagagacggagtttcaccatgttggccagtctggtcttgaactcctgacctcaggtgatccacccaccttggcctcccaaagtcctgggattacaggcatgagccactgcggccaatttagtttaaatttcaatttaaagtgcctataacaggctgggcatggtggcttacgcctgtaatcccagcactttaggaagccgaggcgggctgatcactcgaggtcaggagttcgagaccagcctgggccacgtggcgaaatgccttctctactaaaaaatacaaaaattagctgggcatggtggtgcatgcctgtaattccagctacttggggggctgaggcaggagaactgcttatactcaggagacggaggttgcagtgagccaagatcgtggcactgcactccagcctgggtgacagagtgagactctgtctcaaaaaaaaaaaaaaaaaaaagtgcctgtaacagaccaggcactgctctaaacaacatatacactcatttaatccgctgaggaatccctgatgtatatgttgctcatttaatccccatgaggagtcttcaggggattaaatgagtgtaacgagtgtatatgttgcttagatccgtgcctagtctgttacaggcgctttttaagtgttagctgttgtgaagttgatgatgatgatgaatactacaacttctgttaatgtgtgtagagctggctttttccagaaattttcatgcagtctctgccgaaacaaaagtgccagtgaggaggctgagatgggaggattccttgagcttaggagtttgacaccagcctgggcaacacagggagaccatgtctctacaaaacgttttaaaaagttttttttaaaaaaagtgccaatgataattctggctaacatgacgaaaccctgtctctactaaaaatagaaaaaaaaaattagctgggcctggtggtgggcgcctgtagtcccagctactcggtagcctgaggcaggagaatggcatgaacccgggaggcagagcttgcagtgagctgagattgcgccactgcaccccagcctgggcgacagagcgagactctgtctcaaaaaaaaaaaaaaaagtgccaatgataatgttccagatgaagctaggaagagtaaatgtgctattcttttcatttgaaattttatagaaacggcgaagatttaaagagattgccttattgtggatgatatatccactgcgtctttaaaaacggtgctctgaaaattttttgttgtttctctctttctagacgctagagcggtcttatttgttgaagatcaatggaaaaggtgagaaatgaacatgtttgtctgttacattttctactcattatattgaatgtatagctttgagctataagtcttaatattcttgcttagactctagataacattttggactttaggtttagtttgtggataattgtcctgtttattagtataaagtttttctagtttccttttggtgtccttttctgaaattcaaatacgtatctcaacctactttttctgacgtctcatcatgtgaaaactcctcttttgtctatagtggctgaaagaccacaacatatgttgatgagagtatctgttgggatccacaaagaagacattgatgcagcaattgaaacatataatcttctttctgagaggtggtttactcatgcttcgcccactctcttcaatgctggtaccaaccgcccacaactttctaggtaggtgttttgagtagggaaatacgccttgacctgaagaaactgggcagttagttcatcacataaaaaataatttaatgaccttttagtagctgcctgctctgattaaatgagatttagattctggaaagatctctgactgtaatgtggtaaatgaattggagaaaaggcaaatgcttataacaaaaatgttctaaaattgattggattgtggtgatggttacacaagtctatgagtatattaaaagccattgagtagtacactttaaatggggaattatattatttgtgaattatattcctttttttttttgttgttgagacaaagtctcactctgtcacccaggctggagcgcagtgttgcgatcttggctcactgcaacctgtgcctccttggtacaagcaattctcttgcctcagcctcctgagtagctgggattacaggtgcccgccaccacacccagccaatttttgtatttttagtagagatggggtttcaccatgttggtcaggctggtcttaaactcctgacctcaggtgatccacccgccttggcctcccaaagtgctgggattgtaggcatgagccaccacgcttggtgtgaattatatttcaataaggttgttttaaaaagaaggtaagtgccaagaactagttaggggactcttatagcagtttatataagaaattgtggtagtctagattagggaggtgaaagtagaaattgacagaagcagatagatcaaaagatatttagggccaggcatggtggctcacatctgtaattccaacactttggaaggctgaggtgggaagatcacttgaggtcagaagttcaaggctgccgtgagccatgattatgccactgcactgtagcctgggcaacacagtgataccttgattaagataaaaatatatataaaagatatttaggctgtcaaattgacagaatatgggtcaagaatggttcttgcatttatggatacagtaagtaacaggattaatgatgatgccatttgttgagaaaaggaacactaacggtctggtaatacattaaaaaaaaaaatatgccattatcaagttggtttgtttcaggaattcaagaacatggtaacatcaaaaaatacattaatgtaattcattgcattaacattttatgcagtttaatgctctttcataataaacactttagcaaaattgatatagaaaataacttccttaatttggcaaaagatacccaataaaaacctagatgtatcgtctcttttttcagcatggtagtggaggcctgagccagcattgtaaaataagaaaaagaaaagattggaaatcagggaacaaaactgtaatgatttgaagaaatgatttttacataggaaactcaagagcatctgcagacacattattagaaataaaagatttcagcaaaatatctggatataggttcaatatacatcaatcagttatgtttctgtactttagctgttagaaaattaagtcttaacctacagccatgcattacttaacgatggggatatattctgagaaatgtgttgtaaggtgatttccttgtgcaaacattatacagtatacttaggtaagcctagattgtatagcctactacacacataggatatatggcatggcctgttgctgctcataggttacaaacctgtgtagcatgttactgtactgaatactgtaggcctttgtattaccatggtaagtatttgtgtatccaaacatatcacagtaaaagtaccctataaaagataaaaaatgggccaggcgtggtggctcacgcctgtaatcctagcatgttgggaggccgaggcgggcggattgcctgagctcaggagttcgaaaccagcctgggcaacatggtgaaaccctgtctgtactaaaaatatagatataaaaaaactagccaggcatagcagtgtgcacctgtagtcccagcgactcaggaggctgagacaggagaattgcttgaacctgggaggcagaggttgcagtgagccaagatcgcgccactgcactccagcctgggcaacagagcgagactccgtctccaaaaaagaaagaaaagataaaaaaaaagatacaaaatgatacatctgtataggacagttatcatgaatagagcttgtaggactgaaaattgctatgggtgagttagtgagtgagtggtgaatgaatatgaaggcctggctgggcgtggtgggtcatgcctgtaatctcagcactttgggaggctgaggcaggtggatcacgaggtcaggagttcaagaccaacagggccaacatggtgaaaccctgtctctactaaaaatacaaaaattagctgggtatggtggcaggcgcctgtaatccactacttgggaggctgaggcaggagaattgcttgaacctggaaggcggaggttgcagtgagccaacatcgcaccactacactccagcctgggcaacaggagcgaaactctatcttaaaaaaaaaaaaaaaaggaatatgaaggcctagtacattactgacgactgtagactgtacaaacattgtgcacactaaatttattttaaaaatattttcttcaataataaattaaccttcgattactggatgaccactgtcgtatgtgtagtccatcgttgactttttttgtttgtttttaagacagagtctcactcttttgcccaggctggagtgcagtggcatgatcttggcttactgcagcctgcacctcccaggtccaagtgattctcctgcctcagctttacaaatagttgggattacaggcgtgcaccaccacacccagctaatttttgtatttttaatacagacggggtttcaccatgttggccaggctgatctcaaactcctgaccttgagtgatccgtcttccttggcctcccgaagtgctgggattacaggcatgagctaccatgcccggttttttaagttttttagaaatttctctaaaacatgattaaaggacattaaataataaataaatggaatagattcaattttataaaaatgtcagtttttcccaagttaaaatatagattcaaagtaattctaggcaaaatctcaacatactgattctaaaattcatgtgaaagagcaaaagactgcccaaaaatgtcaggtcgaaattcctggaacctgtaaatgttacctgataaggaaagtggtctttgtagagatgataaggattttgacatggagagattatcttgaattatgtgggtgggcccttaatccaatcaaaagtatccttgtaagagagaggctgagggagataacgactcacagaaggggagaaagtgatgtaaagatggagggagaaattggagtcatgtggccacaaaggagagcaattagccactaaaagctggacaaagcaaggaacagattctccctcaaaacctctggagggagcactccaaaaaaaaaaaaaaaagtgagttgcagacattgtgactcttgatacctccacttacctttttttttgagatggagtttcgctcttgtcactgaggctggagtgcagtggcacgattttggcttactgcaacctctgcctcccgggttcaagcaattctcctgcctcagcctcctgagtagctgggattacaggcacgcgccaccacacccagctaatttttgtatttttagtacagatggggtttgtccatgttggccaggctggtctcgaactcctgacctcaggtgatccacctgcctgggcctcccaaagtgctgggattagaggtgtgagccactgcgcctggccctacttccacttatatctcgataggagaatatataatatgacctcagagcaaaacaccatagagcaaaacattggaaaaattgactacaattaaaaacttctgtgtgaaaggcaatggaagggcaccgtggatcaataaggccgagaggcgagacaaagagggcaaaaatcttctttattgagctctcgggcgaggttcactggtccgcagggggagggccagggaagtctcgctgtgccaaaggtgcagcgtgcttttatggatgctgggtgaggagtggtcagggtaggggcagggtcggttgagtttcacgcttctgagtgtgacacgccctagtgggcatgtgcgttagtcggggtggcaggaacaggaaaggtgaacccggaaatgctgagtcagggtgtccgaggtggcgatcgccatcttggagtcttcaccggagtccaatcactgtgaaccaaaaacgaagtcaaataacaagtttcacactttgggaggccaaggtgggtggattacctgaggtcaggagttcgagaccagcctggccaacatggcgaaaccctgtctttactaaaaatacaactattagccaggcgtggtggcgtatgcccataatcccagctactcaggaagctgaggcatgagaatcatttgaacctgggagacggagcttgcagtgagccaagatcatgccactgtactgcagcctgggcaaaagagtgagactctgtctcaaaaacaacaacaacaaaaacacccaaaaaaacaagtttcagactgggagaagatatttgcaacatgttaactattgagagattataagaaaaacaaggccaggtgcagtggcttctgcctgtaattccaacactctgggaggccaaagcaaaggctggcttgagggcagaatttgaaaccagcctgggcaacataatgagagcctgtctctacaaaagtagaaaattagccaggcgtggtggtgcacacctgtagatttagctacttgaaaggctgaggtgggaggatcgctcgagcccaggaggtcaaagctgctgtgagctatgatcatgccactgcactccagcctgggtaacagagttaaaccctgtctcaaaaaaaaagaaaagaaaagaaaagaaaaacagaaagccaaatagaaacatgggcaagggctataaacaaataatgcatggaagaagaaacttgattggctaataaacgtctgagatgttaaactgtgcaataggaaaatgaaaattatgtatatatatatttgataaaaatgaaaaggctgacaattccaagcactgataagaatgtggagcacaaggaaatctcatacattgctagaaatagatttgtccatccactttggagaatctttagtaaagtgaaacgtgtatatcttttgacccagcagttcctctcctaggttcatattctacagaaatgcttagagataaacacaaggtgttgtgttcaagaatttttatagcagcattgtttggaattgcaaatgaattggaaataatccagatgttcatcaacaggcacatgggacaaatgttttggtatatttatacaatagaataccttatagcaatgaaaataaagtttgtttacatatatcaaaaggattaatttctgtaaagcaatattgaattaaaacaagttgcagaatgataaacagatatgcaaccagaaaaattctaagtgtataacatgtaaaaatgtcataaaggaaatgcttgaaaatgttagaggattgcaatgagggtatatttgtggtgtctaattttttgaggtaggtggcaagtacagagtatttgttacatcattctctatatttttctgaatgtctgaatatttatataaacacctagtcaatagatagaatccatttgcatgattgaatattcaaggcagtgaagagattattgatagagtaaggttcctgaggtggggagcaggatgagatccaaagtgaggtaaaggggttgtctttaaaaagactgtaaaggagctatgattttggtagacgtatcaaagaattggttgacaattggagagattattttcataaatgtttgtttttcttggcttactaacaacctgaaaagacggtgatgtatgtttatgaatatgcatgagaaaatgtgaaaatagcacgtttgcagtctggtgaaaatgtaagccaatattttagacttatctataagacttcctactaggcttatttacttactatctaggggaggcagcaagatgattttaaaatgatatttcgatatgttttattgtgtcatgtacagtaaagtgggttttcttctttgaaaatcatttaggaactttctaaacttcaactcttttttttttttttgccttagtgtctttgtgttgagtaatcatttttgtgactctgcttcatttccttgctctaagttgagacattttttcccccgtagctgttttcttctgagtatgaaagatgacagcattgaaggcatttatgacactctaaagcaatgtgcattgatttctaagtctgctggaggaattggtgttgctgtgagttgtattcgggctactggcagctacattgctggggtaggtttctgccatttgacttttaaagggggattcaagtctaaaagcaaacagattcatggttgagagggcatatgctattttttgggagtcctgggtctctgttaaattactaaatggctatgtgacttggagtgagtcattttacttctggcttcattttcatctatgatattagatatttagatttgactagataatctctagaatcctttttagctcaggttttagaattctggcttattttagcagtaataagagcagttatcattgattgattgcttactgtatgttaagtttgttataaatgttttacatgaggtactcatttgacccttactacaacgctatgaggtaactatgattatagactcatgccaggaattttattccttaaaataaccttgtgaataaaggtaccattgtctaattttacaagtgaggaaattgagacttagaaagttgttactttctgagatcaatcacttaatatgtggtagagccaggattcaagatttatgcattgacactttatgatgtaaactttagccctttgttagtttactgttcaatgggagtcaagataatagttttggatttaaatcctagctccactacttaactagtaatgtggcctagagttagttattttgtgtctgagtttgtttccttttctgtaaggtgaagaaaatatctaactctgtagaataaagttccagaaggaaattattccattatgttgtgttttggaggtgctgtgatatatacagcactttacacagtggtagagtgagctattgctcacttatctttctagactgtttaaaggcttgtgttgggatcagaagggttaaagaatttgatgaagtatcttctagtcgtaggagtctctattttcttaacatcattctagagtccacttattgctgagaatctccttttaccttatttattgccctgatatagctatcgcatataattcttattgtaaattgccttgatttcttttgggaaaaaggcattgtagtagtgtttatattcttttttactctacccaaagtgtatctttatataacgacctttagaagatgtagagtttaaatttagctaccttgattttggatccctttggcctgtaattgttacatctcattataaattagaaatgccatgaggtaacttagtacataattgtaatttattcaacattttgttgattttatttgggcatttttccaaagcagaagtagagatggagagcaggtaaaacttcatagattgctacctagaaattaggcatcttttttgataaaagaatggggccatttttttcttttctttgctgagtgccctctgtcatttctatcatggtctctcttttagactaatggcaattccaatggccttgtaccgatgctgagagtatataacaacacagctcgatatgtggatcaaggtgggaacaaggtatgctccatgaattgaaagtactggaaatcagaactaaaggtgatttagtcatatacacttaagatggttcatttatgtgtagtttctaattaccttttttttacttgtaaaatcaatttgaggaggtataattattttaatatgcatatactttaaatgtacagtttgatgggttttgacaaatgtatacacttgtgtaatcaccacattgataaagaggtagaacatttccattaccccaaaatcttttctccctcatatacctttacattcagtcacccctgtcacccctacccacacatactttatccctggctctagacagccactgatctattcagctttcttacatgatagttcgtttgcaaagaatttctcaagttgtaattcatataaatttgttacttgaaatggggttgtaacatgtgctctaggtttttctttcgtttttttttttatctctctcttatcacccaggctggagtgcaatggtgcgatcttggctcaccgtagccttgacctcctggacttaagtgattcttctgcctcagccctcccatgtagctcagactataggcctgtgccaccacacccagctaatttttatattttttgtagaggcgggggtctcactttcttgcctaggctgatctcaaactcctaggctcaagcaatctacctgccttggcctcccaaagtgttgggattatgggtgttagccactgcacctcgcctaggttgttcttaaaacaaaaacaaaaactacctggaataacaaaactctccctaattggctggatgcagtggctcctgccagtaatcccagcactttgggaggctgaggtgggctgatcgtgtaagctcacaagttcaagaccacgagttcaagctcacgagttcaacatgacgcaaccccatctccacaaaaaatacaaaaattaaccgggtgtggtggcgaacgcctgtagtttcagcttctctggaggctgaggtgggaggatggcttgagcccggtaggcaggaggttgcagtgagccgagattataccactgcactccagcctgggcggtagagctagaacttgtctcaaacaaaacagaacaaacaaacaaaaactctccctaattgatagaagaaacagtaaagttgagagaattgggttgtttaccttattttatcaacaggatggtttacaactagagtctgccttttgtgactgtaggcacactaatcgcttgttggtttatgaatttctctctgatggactttggggaccttgataagacagatcaactttttgacctacaataagagcatggcttatactgtcaaagcaacttcctttgggctttatgtacatgtcatgtggtgtaaagagagctgggctgttgctgaagaggaggctccatctgtagttcatcatgtcactttagaaaagttaatcttgtttcacattttgtttatatcattcgttcgtttttactcatagaattgtaaaatattacttttacaattatatatggaaaacttacacttttataatacttttatttatgttatttaattcattgtagtgaaaatcaaaggagatactataaaagtgctttgggagacatgatgtttctttgtttcatttttattctgaagagaattatgatttatttaccactagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggtgagagataggtacttgttggtaatagcaacttgattcacatgagctttctcttttttagtcatcttaagtcatgcttaggaagagcccatatgtgtgtgatgccacagaaggcattctgaacaagttaagagatgccgtgcttgtcttcttatatttctattctctaaagtagatgctttgtgacctaaatgcttaaaaggtcatgtataaacaggcagacctagatgtttgggcctgaacctgaaaatgattatttctacagcaaatttccaagagagcttgtaaaagtcaccttatgcttgcagtgtttctaatggattatggttggctatttgaagtttcttatgagtgattttgtcctttcctttttaggactggtctttgatgtgtccaaatgagtgtcctggtctggatgaggtttggggagaggaatttgagaaactatatgcaaggtatgggaaaaatatgaaagaaaacaataatgttttaatcatggtttctcttatttcaggggtccaaatatcaaaagtacttgtcaagaatcttttgaagcatctaagagaaaaagtgactaataattttggtcagatttgcttcctgactcttcaccaaaattgagttgtgtcttcttctttcttaaaactttggaatgtataaataggttcttgggatttttaattgatccttttaaaatttaagatgactagtagggttattattttgctctgtcatatagtacttttgataagctatgctttatgttgcataaaggaatcatgagtgactaggacacatatgtcagtagtttattaaaattaaataggtcaggtgcagtggctcacatctgtagtctcagcactttgggaagatgaggcaggtggatcatttgaggtcaggagttcaagaccagcctggccaacatggtgaaaccctgtctctagtaaaaatacaaaaattagctgggcgtggtggtgcacacctgtagtcccagctacttgggaggctgaggtaggagaattgcttgaacctgggaggtggaggttgcagtgagctgagattgtgccactgcactccagcctgggtgatagaacgaaactccgtctcaaaaaaaaaaaaaggaaaaaaatttagcacagtcttaagagatttggcttccttagtttttactcctttttattatgaaagatattattggtttagtgggattgcgatcatctgaaggcacctaaaactgcctcattttcccctatggctttagctagagtaaaataaatatcatattcctttttttctttagcaaaacttagagaaaatttaagagttttcataactttatattttaatgtcttcaagttgtctacaataaagtttttttagggaatatatattaaataatattatctgtgcctttcagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggtaggtagaaaaaattcttcctagagtactaagaagagaaccttaggcagttattatttgtgaattcctcacttgatttcacttgagataagtgaagggagtttgcatagttgtaagcagaagaacactgttaaaggcagagagcaaaggaaggaaagggtatgatctgtgcctataaatgttttttagtctaagccgtgtgggaaagacacagttttttcttatacacacatcactgtaataacatttactcaagaaaaatagaaatatacagttatgttagtttaggacacacacaaaaatgtgttaggatgtacattcaatttaaactatgtaagccttgagcctggaaagtggaggctgcagtgggctgagattgtgccactgtactccatcctgggcgacaaagtgagaccctgtctcaaaacaaacaaacaaaaaaccaaaaacaacaacaacaaaagtatgtaagcttataaagagagtcctttcagtgaatggtgagatcaaattctaatctcaagtctgtaaagagacttcacagaagaatcaaggctagaaatgggacatggatttggtgttttaaaaaaaagtttgagagaggagctttccatttggaaagagtggtctgtatgatacaccagagacagggctgggttttatgcagtgtggcaagtaagtctgttttgatggtgcaagtagattaattattggaatatggagagatggctatggctgggggaagggagatagaaggtagaagctgacacgtcacggataggtagcccttgtaggtttctgagaggaaaatagcatcaaaatgttaagatgaaaaggaaggttcttgcttctggttacagagtgtcttgctgtgagaagggattagaggttagcctagggagattgttgtactagttggatgacaggctgctttgatcttggatgtaaactatggaaacgaggaaggagtagatcctcaattctaggaccttaaaaaaaaagacaaatgaaaagtcaggaagtaaatggaaagtgagttaaatatactgctaaggttacagtttaattcaaaatttattgtgcagtagctatatgtaaaacacaatgttaagtgctctgagaatataaataaatatgctgccctctggaaacttctaatttagttggaagacatcgacatatattgaggtaactattatgcaagacagattatattatagaggctagagtgacatttttaaaataaaaatcagataatgtcatttgtctgcacaaaactactctttggcttgctaacccatgcagaattccttttttttcggggggcgtcaagatttcactctgttgcccaagctgggctgtggctcactgcaacctcaacagagttctttctttttgcaaattgagctataattcactctttttaaaatgtacaattcagtgttttttttcttttcttttcttttcttttttttagtatatctgcaagtctgtgcaaccattaccactatctaattgtagtatttatttattttatttttttttttttgagacagagtcttgctctgtcaccaggctggagtgtagtggctcgatctcggctcactgcaacctccgcctcctggattcaagcgattctcctgcctcagcctcccgagtagctgggactacaggcgcgtgccaccacacccagctaatttttgtatttttagtagggacgaggtttcactatgttggccaggatggtctcaatctcttgacctcgtgatccgcccacctcagcctcccaaagtgttgggattacaggcgtgagccaccgtgaccggcctgtagtacatttttatcactgtagataatgaaaccctttatccattagcagtcactccctgttcccttcttccctcagcccttgacaaccactaatatattttctgtctctagatttgtggacattgtggacattccataggaatggagtcatataatatgtggccttttgtgtcaggcttctttcacttaacatgttcttttattcatgttgtagcatgtatcagtacttcattcctttccatccagagttcttacagtgccctacaaggtcctacacaactggataacccacctcatctgcggttactttcccctttgttcactttgctccaaccctattaattttcttgctttttctcaaacatgtcaaccatgctcctacctcaggatttttgctccttcttccctcttgaatgttaaaatgcaccccctcttcccatagccacatgatttgctttctaacctgttcagttctttgttcatatgtaacattttcaatgaggtccttcttgacaattctgtttaaaaattatacccccttcatctttatccccagtactctctgtcttcttttcctgcctatttttcttcctggcatttattagacttctgtgattcaagctatatttaaaaaaatgggtatttggcaacatgtgtagaatggagtagatgtgaagggcatcaagagttcaactgggaaactttcagtagtccatgtgagagaagttaagactttggcttgggatagtcataatcaaaatggaaaagaaagtgtattcattcaacattatcaagacttactgtgtgccagatgtgttgctagtgctaaacatataaatataaataagatgatccttgtgtgaagaagctcactgcctcgtgtagtggagaaatcactggaagagctttttcagaaatcacaaattgagatccattgttgctaagggcttgtcagaatatcagtgaaggtgaggtggacgtgtgtgttttgaagaactctgcagtgatggaaatgttctgtatctgatggctattgagcacttgaaatatgactagtgcaactgagaaactcaaattttatttcattttaaatagatatatgtagccagtggctaccatattgcagggcactcatctactgaataatgagataggtatatgtaaaaagctaattataacatagtgtgatatatgtctggtaatagagctgtgtactgtggaacatagggttctctctctctcttacctattttgctgatgcatgttataactaacacatatgactaggtattgaagaaatagaatcagtgggatttagaaatggactgatgaatgatgaagagggagaagtcaaatataaaaatttaaaattttaatgtctgagtattagaggctcacatggtggtgtaattgacacaggaagtagaaataaaaattgtgtgattcttgacctgttttttgcattccaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggtatgaatagatttctctgcttattggtaattattgaaatccaaattgaaaggaatcaatcatgatcttcaagtcatcatttaaatggttatcaataaaatggtttgagaaaaagaggtagtctgtctcatttggtacagaatgttgcttttcctgttcagtaatgttttctccttttctttaaaatctgttgacacaaaggcatgcctatcaaataaacgccatcgccccattggaattggggtacaaggtctggcagatgcttttatcctgatgagatacccttttgagagtgcagaagcccagttactgaataagcagatctttgaaactatttattatggtgctctggaagccagctgtgaccttgccaaggagcagggcccatacgaaacctatgagggctctccagttagcaaaggagtaagtatatggatggaattgtttttgcctgtgagtacctgtagtgggctgaatggtgaccccacaaaaggatatgtccacatcctaattcctggaacctgtgaatttaatttcatttggttcaaaaaaaggtattttgcagatgtaattaagaaccttgagataaggagatttacctggattatccaggtgagccctaaatctaatgacagttgtcctgcaagaggcacagaaggggaagcaacgtgactatggaggcagaaattggagtgttacaaccacaagccttggaatgctgataaccactagaagttataagaggcaaggaacagaatctcttctagtgcctctggagggagtgtggccctcccaacatgttgattttgggcttctggtcttcagaactatgagagaataaatttttgttaagttaccaagtttttagtaatttgttgcaccagccataggaaacttaaatacctttgtcctctggagtaaaaaggatactctgttttaatctcttatttagaactagtcattgctaaaataatgtaagagggatgctgccaatgttagttttctgtgggttaaaacatggcattcgttatctcacagtttccacaggtcaggagtccagacttagcttagctgggccttcttttctgggtctgtgttcaagatgttggtaagggctgtgatctcgtctgagacacagagttctcttccaagcttacctggttgttggcagaatatatttcaaggactcatggcatcttgcttctttaaggccagtgggagagaccatctctcgtttcaaaaggggcacagtctagtctcttttgagggttttcacctgataagttaggtccacataggataatgtcctcaccacccccctgtcccgcttttttttttttttttttgagacagagtctcactttgttacccaggctggagtgtgtggtgtgatcttagatcactgcaacctctgcttctcaggttgaagcagttctgctgcctcaagtctcccgagttagtagagatggggttttgccatgttggccaggctggtcttgaacttgtgacctcaagtgatccgcctgccttggcctcccaaagtgctgggattacaggcatgaatcactgcacctggcgtaatcttccttttatttaactcagaatcggctgatttgcaaccttaattacatctgcagaaacctttcacctttgccataatcgctggagtgacatgcatcctattctcaagtcatgtccatactcaagtggagattataaatagcctgtgcaccaaggtgtgggaatctgggaagctgtcttagaattctgcctttcccactgcctttattatcagtactatgattctttactatataaaatgttaatttcatttctgacattcctgctgatattagaaaatctaatgtgtggttattagaaaataggtgtttttagctaagtaaacagatcaagggacagatgaaggcactgaagaaagtaacatttttagtgttaaaaaaagagaatgtgtcagccacacccttttatgaatgttagagttttctggtttgtagatatgacatgggataatcagttttcttagcctgcttctgatcaatatgactacatggaattttgtccaggaaaatctctggagcttgtattcctcatagaggttgattagaagacagcatttgttgggatgtggggacatggcagctagtcatttgtgggttttttttttttttggtcatagttttaacttgctgtagaataaatttgagttgtgtattccttagattcttcagtatgatatgtggaatgttactcctacagacctatgggactggaaggttctcaaggagaagattgcaaagtaagtgaaaagatgtaaagtagctttgaaggcagaagggtttaggttcaccttctggatcttcagaagttagatatgtcattttaacttcttaaactcatttattacaaatggggctaaaatggcctatctcacaaaactattttgggaaaaaacttcgtaagataatatatatagtaacctggaagttgcttggcacaatgaaagcatttcagtacctggtaggaattactattattagttgatcttattttagggacttaacacacctagattaggtaattttctttctcattaaggcttttttccaactatgatttttttttttaaatgtttttcattcttatttatttcccaatttagttacatcgggcatataaatggcttttgtttgaattgattgtcataggaataatggattttggaagagtttttggagggtaatgtgtttagactatatgaaaaaaaaatttttaaattgagtttttgtaggcctttcaaactaataagcataagggattcgaaggcagacagaatgttttgcagagtgaataacaaagcaaattgtttttgttttctatcgtgatgactttgtcatttatgggttaatgcatatgcaaagtgattaatatttggagaatgaagcagtagctttaaaatgctctttaaaaaaaataaccgtttgccttaaaattgttaaattaaaattgttttcctactcaaataatacatgttagaaaatttaggaaaacatagatttggaaagagaaaatgaaaattatactaatactgcctcccccagaaaacctgtgtgcatcttagtgtctgtcatcctttaggttttcttccaagagtacacatacatgtgtatttacatggaaattcaacttttaagaaaatggacctgtactgtatttatatatatatatatatatattttttttttttttttttcccctcaaaatactatggcttagttttttatatacatgactttttttctaatttcaaaattagtatatgaacacaaatttattattaataaagctcaaatacagaaataaaatagaaagtaaaagcccttcttcatacttctgccaaccatttgtctcagaaaacaaaccaaaaaagtaacttattctttttcccagagataagacttgttaatggtgtgtatttttctagatctttttcagtacatttgcagataggtacacatacacggttttgtcatataaatgtgatcaaacttgatgtattctgggctgggcaccatgactcacgtctgtaatcccagcactttgagaggctgaggtgggtggatcacttgaggtcaggagttcaagaccagcttgggcaacatggcgaaacttagtctctactaaaaatacaaaaattagctgggcgtggtggtgcatgcctgtaatcccagctacttgggaggctgagacatgagaatcacttgaacctaggaggtggagattacagggagccgagatcatgccactgtactccagcctaggtaactgtgactctgtctcaaaaaaaagacttgatgtattctgagacttgttatttagtgatttattttggagctctttctcttttagtacctgtaggtctacctaatgtttttaattattatagacaattccatagtttgaatatatcatatatgtaggacttttcacaacatttacctgtctgtagacagatgatgttgctattttacagatgaggaagtaaagacatgaagatagttggtggtttgcttgatacctcactacaaagtgacagagtaaggtggagaaccaccccccaaaaaaagtaaataaaaaaataataataactaaaaagtagagaacccagttgtattagtcgattctcacacagttataaagaactgcctgagactgggtaatttaaaaaggaaagaggtttaattgactcacagttccgcagggttggggaggcctcaggaaacttacaatcatagcagaaggggaggcaaacaggtccttctttaatacggcggcaagcaaagtgctgagtaaagggagaaaagccccttataaaaccagatcttgtgagaactcactatctcatgagaacagcatgagggtaacctcctctgtgattaaattacctcccgccaggtccctcccgtaacgtggggattatgggaactacagttcaagatgagatttgggtggggacacagccaaactatatccagttgtacagactccgtcaggatatgaggctgtatgctaagcactgtatgaatccataggtatagaatgtaggaaagacaggctctttgtgttttaaaaacttgagactaagaaaacaagtagttaaggtatacggaaaggtacaggtcagagaaaatgtttgcagagtagatatttgtatttgacatttgtatttgtgcctgcctgatgaggaaagatgttttaaaattgctatcaattaggctgagctttgaaggtgagccaggggcagttgggagatttctcagtgtgtcagatagtgtattttctcttattagtcaaaagatgttaaccttcttgcaggaacttataattgaagaatatactttgagcataatttcttcctctttacaggataatggagaattgtggtgatatttctctgattctgaacactttctcatcattatttttccagaaggggcctagcacaatgattttataggcacttggaaaagagtgagggttggatgagtgtaacctaatacaggtggggagcgcttcaacagtgatttgaatatttccctacgcaagatagtgtatcaagtgttatgattcctgagtgccacagtccaagtggcataaatcatggtatgataaggatagccaacaataaaaattgtactaattcagtttaggagtcaggcatttaagaggagagtgggctataatagcacccatactgtggaattgcctccctgtaggagtttaatttgaaagtcaacgtgtgagttcaatgcatgtacgatgttacatttacatttactacatttatctacatttactacagtgacttaaagtagctgctttcctggcagattgtagctttgggactagtacctgataatctccttttctttaggtatggtataagaaacagtttacttattgccccgatgcctacagcttccactgctcagatcctggggaataatgagtccattgaaccttacaccagcaacatctatactcgcagagtcttgtcaggagaatttcaggtgagcagttcacaaccagccttacagggagatctttcaaaagcctgatgttgggagtaaatgctcactcatgtttaatttgcccattttcttagtttgggtgcaaactttgataaagacagtcatcttcatctctaatattattatttgttattaatatttcagcacaataggcatttaataaataatctgttgaaagaatgagtgaatgagggtcgagtatgaaagtaagttgttgatagttaaacatgatgtttaaccattatgtaatcatagtgatatattctataacttctcccagatgcttaagttaggatactcaaaatgtataaagaagtatcatttaaggcagtggttctcagacttggttaccaattagaatttatggtgggtgagaccagtggttttttctttgtttttaaggttcccaggtaattcttatgtgtagctagggttgagaacctcaatttaaaagactatttgtgaatttccagatatcttgaagtaaagttctgtaaagttcgagaaggatacgtttccaatttttttaacctaagtatttatagatttacccatcttaggcgctattcttttcacttttgcaaacgccatatgtttcttttttaatgaaaatattttttcagctttattaaggtataattgacaataaaaattgtgtataaaaccaaggtatacagtgtaatgattagatatgtgtatatattatataacgattaccacaccacaatgtttttgttgtcgatactgtttttgagaaaatgtctcactttgtcacccaggctggagtgcagtggcatgatcttggctcactgcagcctctgcctcctgggttcaagcaattctcatgcctcagcctcctgagtagctgggattacaggcatgctgcgccaccatgcctggctaattatattgtttcttgaataacagatgtcaagatcttaaaggaatatagctttcgtgtggtggcattgatgtctcgtctttataaaagatagaatttaccaagcaatctagcattaaataactcttaagtgattttagtttaagcttcaaagctgtagtcttttctaagcagtcactgttatttatttcttcatacattttctgcttttccattcagattgtaaatcctcacttattgaaagatcttaccgagcggggcctatggcatgaagagatgaaaaaccagattattgcatgcaatggctctattcaggtatagaatgaaaatgaagtgtgctctgcaggggctgagttggacattgtggtacctcctcactcatgctagacaatggagagaatgacttcattgtgttcatctaggttttgcttgtgtagctctgttcacctctgcattgttgtgctaggattgtacacatctttacataacccttaccatcttgtttttatgcaataatataaaaaagtagttctcaatttttctgcatcttagaatcaactggggagcttttaaaatcctgaagcttaggttgcattccttaccaattaaatgtctaggaacaggaaccagacatcaattttttttttttttttttttttttgagacgaagtctctgtcgcccaggctggagtgcagtggtggaatcatggctcactgcaacctctgcctcctaggttcaagcgattctcctgcctcagcctcccaagtagctgggattacaggtgcctgccaccacgcccggctgttttttgtatttttagtagagacagggtttcaccatattggccaggctcctgacctcaggtgatccgcctgccttggcctcccagggtgctaggattacatgcatgagccaccgtgcctggcctcagacatcaataatttttaaagattcttttggtgattccaaagtatatcaaaatttgggggatcatagatagaaagactgaaattaagagagtcaagcttaattaaaaatcatggttgacgactgatagtccaaaagacagagtcacaaatcgtgtaaatatttgcaactaagagtcaagaggcatttatttgcagatagaggtgtctggctaaatgttggtctgcttagcaacacagatgaagagtcctataacagttccatatttaatgacagaaactgtagcattagccagtctgtgtgttttaatgaaagttaaccctaggcctaagaaaacctgattttggattccaaagggagtttgaaatcctagcttatttaaagggttttatctcattgcttcccttggtccctgtgaattacagcccttattttttgtgttttctgcaaaactcaagggtcatttattgctgcttagctctgacttttcctttctttaagtgcctctagaagaatgaatgtttgggtcataaatcaattaaaaaattaaaaaattggtttatgaccaacaaaaaagggatgctgaaattactatcaccagattgatatttggttggttagatgggggttttgttcaactttctaaatagtcttggtaaacttgataaggatcatatcatatgatactgaatggtaaggtcagatctggcaggaagtaaaatgaagatcaaagcttgtgtcactattctattaatcatacactgctttctttaactggagtaaagtaaacattgggttttccttctttagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcaggttggtagagaatatcaaggagtacttaattgccagcttgagatattttggcattggaatgattttatgttttagccacctattaaatattatcacctagaagttctttaagttcaaatccagaacgttaaaaccaacccatggtttttgtaccagaacagggtcttgccttggattttcttgtttctgttaggtttatttccttcttaggtttgaaaccttgtagttacctgtgatgctttccttcctttactgtccgtacaattaccaagttgtgttgattgttcctttgtattatttcttaaatatcttccttccttttctgctgctgttattctaaactgaccttattgcttctaggatctctgctcccagccattttgtgtgcattaccaccattcctcagataaaactttgcacacgtcaacccgctattcaaaaacatccattgttttctcactttataaagtgaaagccagcttacttagctagtcgttgccagctgtaaagtctggtgattttggattatgttcttattccctgataatgtattgggtatttaagtagaattataaatttgttttttaatttaacatttattgaacatctagtatgtgccaggactgaggatactgaatagaagatgatgatctttatctttgaagtcttatagtctgttgttacacagagacacagtctagctctctaaacagttataacctaaggcagacatattgtcttgggcaaacctggaagtcatatgcataaaaacaaagacaaaagaataaaaatgtttgacctttccaaagagataagcctgttttaggagtgaaaagaacaggatatttctgtctgactcacaaagcatttttgagagtactcctagaggagatagaattccaagtttaaaaaaagtttgatctggttcatgggaatgtattttattttatgtatgtatgtatgtattttgagacagagactcactctgttgccccggctggagtacagcggcatgatcttggctcactgcaacctctgtcctgggttcaagtgattctcatgtcttagcctcctgagtagctaggatcacaggtgtgtgccaacacacctggctaatttttgtatttttattagagatggggttttgccatgttggccaggctggtctcaaactcctggcctcaagcaattcacctgcctcggcctcccaaagtgctcgaattacaggtgtgagccactgtgcctggccaggaatgtattttattttattttaatattattgttttattttattttatacttttttagacggagtctcgctctgttgcccaggctggagtgcaatgatacagtcttggctcactgcaacctcagcctcctgagtagctgaaatttataggcatgtactacccctcttgggggattacaggcatgagccacagcgcccagccaggaatgtatttttttgtttgtttgtttgtttgttttttctttttatttatttatttatttatttttattgatcattcttgggtgtttctcacagagggggatttggcagggtcataggacaatagtagagggagggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcactgatcaacaggctcacaaggcagaagaatttttcttagtacagaacaaaatgaaaagtctcccgtgtctacttctttctacacagacacggcaaccatccgatttctcaatcttttccccacctttcccgcccttctattccacaaagccgccattgtcatcttggcccgttctcaatgagctgttgggcacacctcccagacggggtggtggccaggcagaggtgctcctcacatcccagacggggcggcggggcagaggcgcccctcacctcccagacggggcggctggccaggcggggggctgaccccccacctccctcccggacggggcggctggccgggcggggggctcacacccccacctccctcccggacggggcggctggccgggccgggggctgaaccccccacctccctcccggacggggcggctggccgggcagaggggctcctcacttcccagtaggggcggccgggcagaggggcccctcacctcccggacggggcggctggccgggctgggggctgactccccccacctccctcccggacggggcggctggccgggcggggggctgacccccccacctccctcccggacggggcggctggccgggcagaggggctcctcacttcccagtaggggcggccgggcagaggcgcccctcacctcccggacggggcggctggccgggctgggggctgactccccaacctccctcccggacggggcggctggccgggctgggggctgactccccaacctccctcccggacggggcggctggccgggcggggggctcacacccccacctccctcccggatggggcagctggccgggcggggggctgacccccccacctccttcccagatggggcggctggccgggcagaggacctcctcacttcccagtaggggcggccgggcagaggcgcccctcacctcccggacggggtggctggccgggcgggggctgacccccccacctccctcctggacggggcggctggacaggaatgtattttaaatattggtgtggaatgtctagtattctcacagagtttctcctaataattgtctttactttccttgtagggtttgaagactgggatgtattatttaaggacaagaccagcggctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgataatgattttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccctttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtgattgtatgagattaattttgtcatttactttcatataaaagtcaaatttgaaaaacacattttctgttctttgagaattcagggaggaaattatatgcctttttcttttcttttcctttctgtagtaaaatatacctaatatacaatttaccattttacccatgtttaaacataaaattcagtggcttaagcacattcatagtgttatactaccatcaccactatttgtttccagaacttcatcatcccaaacagaaactctgtatcaataagaacattaactccccctttcccctccaagtccctggtaacctctattctactttctgtctctatgaatatgcctcttctaggtacctcgtataaatggaatacatgtctggcttatttcatttagcataatgttttcacagtttatccatgttatagcatgtatccaaatttcattctttatgtataccacacttttttttttttttttttgagacagagtcttgctctgtcacccaggctgtacgatcttggcttggctcaccacaacgtctacctcctgggttcaagtgataagtgattcttgtgtctcagctttccaagtagctgggactataggtgcgcgccaccatgcctggctaatttttgtatttttggtagagaccagatttcaccatgttggccaggctggtctcaaacttgtggcctcaagggatctgtttgcctcggcctcctaaagtgctgggattaaatgcctgagcctccacacctggactaccacactttgttaatccacttatcttttgatggacatttgggttctttcctccttttaaggaattttgactaatgctcttgtgaacattggcttaaaagtatctattgagttcctgctttcaatttgtttgggtatgtatacaggggtgaagttgctggaaattatggtgattctatctttaactttttgaggaactaccaaacttttccacagcagctacattattttacatttccaccagcaatacaatagggtaccattttctccacatcttcatcaacacttatttttcatatttttgttttgttttgttttttgagagacggtcttgctctgttgcccaggctggagtgcaatggtaccatcatagctcactgcagccttgatctcctgggctcaaacaatcctcccatctcagcctctcaaagtcttggggttacaggtgtaagccaccacacccagctcatattttttataatagccatcttaatgacttgacaatttcattataatgtgtcttggtgtgggtctctgagtttatcctacttgggacttcctgggcttattggatttgtagattcacatcttttgttaaatttgggttgtttttggccattatttagataatttttcttcccctttctctttccttatagggacttccatagtgcatctattggttgacttgacggtgttccataggtctgttaggcgttgtttacttttctttattttttctttctattccaagacttgataatttcagtgtcctatcttccagttttctgattctctcttcttcctgctcaaatctattgttgtgctcctctagtgaatttttcatttcagttattcttttcaactccagaatttttattcttctttgtaatttttgtctctgttgatattctgattttgttaatcattgtttttctgatttcctttacttatttgttcatcttttcctttagctctttgagtatatttaatacagttgttttaatgtctttgttgagtaaatccaatgtcttggctttctcagggatggtgtctatcattttttcttgatactttgaatgggccatgttttctttctttccttttttttttttttttgtatgccttgtaatttttgttgttgaaaaatgggcatttgactgttataatgaggtaactccagtaatcagattctcctactccagagcttactgttttttgtttcattgctatgttgaagactgtagtactccatttgagacatttccaaactttttttttttttaagacagtgtctcgctgtgtcaccccaggccagaatgcagtggtgtgatcttggctcaccgcatgctctgcctctggattcaggcaattctcatgccttagccccctgagtagctgagattacaggtgtgtgccaccatgcctggctatattttgtggtgttagtagaaatgtggttttgccatgttggccaggctggtgttgaactcctggcctcaactgatccacccacctcagccccccaaagtgctggcattacaagtgtgaaccaccacgtccagcccaaactaatttttcagactattctttgtcacgtatgattgccaaagtctttgttcctttagtgcatgttcagttattgttttgacagagatatatgataccttcaaactttttgtcacactaataagattggctggttgcttttaattgcactggacaaattggagaaagaaaaggatgactttagtgatttgaattctcaacttaagtactagacctgaacatttctgtttctgctttgaaagaaactttacgttctgtagctgcagagttgagatttctgaaaccaaacccagaatctcattttgcaagtgcctgagttacaatgcaaattgaattctgagccttgcagtgtgcctttgctattaaagtgaggatattgactaggaatgaatgggatcctgaaaattggaatggtgacatatgggaagatcctgttgaagctggtaatattgaatctctaaattctgatgagtcttcattgccagtagaagcagagttaactgatttacccaaactgattatacctaattgacattaactgctttccctgaggaaactgatgtcttcctctgagataattgccttgcaggacactgctgattgtcctcaggacccaccctgaccacccctctttggttctaaacctataactagattcaagtcccagcaggccccaaaggtgaggtacaaagtgagatctatgaggaggtgtgctacactcaaaaagaactacatgattcttcccatttgagaatatgtgtggaaatggatattaaggatatgtgataatggtggaaggaacataaagttggatcaggctcagtttattgataggggcccacaaagcagaggttttggatttaatattgcagcatgggggatcgaaaagtgcctgctctagctggttggttggttggttgaaacatggaccaaaatttgccctaagtgaagttgaaatgccagtcctgccttggtatactatagaggaagtagttcaaaggcttagggagatcgaaatgttagagtggatttatcatttaaaagaccagctctcccaccctgagggaagtctggaggacacttcaccatgactgtgagaagtaaatttgtgagggaagcctcagcatccttaaagacctctgtgattgctcttttctgtaggtctgaaattacactgccactgaattgggaaacctaaattcagtgggagtaattggatcccatagtgccaggtagagacacttaattgccaaaggcagggtgggaatagttactataatggacagcagagttaaagcagcaatcagaatcgtctgacttggccagatgcagtggctcacacctgtaatcccagcactttgggaggccgaggcaggcagatcacttgaggtcaggagtttgaaatcagcctggccaacatggtgaaagcctgtctctaccaaaaatacaaaaattaacctggtgttgtggcgtgcatctgtaatcccagctacttgggaggctgaggcaggagaattgcttgaacccaggcggcagaggctgcagtgagctgagattgtgccactgcactctagcctaggtgacagagcgagactctgtctcaaaaaaaaaaaaaagtctgactcacagagatacggtttggctagatgatcatggagttcctcgaggtgaaatacatggggaatctattaaattctaacttgatctatataagcagaagagtttccggttaagtgaacaagtctaatttgaataataaaaccagaattatggcccctcaatcaattcccagatttgaactagtttacagacccagaacccctcaaatgaaagggagaccaagtccccttgaggaaggatcccactgcactatcaaagatatatactgttaaatctttctcccagcctttcccagaaggatctatggccttttactagtaactacattgggaaaaagagataatcaaaccttttgaggattactggacacagactctaaactgacactagttccaggaaactaaaacgtcactgtgatcttccagctggagtaggagcttatggaggtcaggtaatcaatggagttttacctccagtctgtctcacagtggctccagggatccctgaaaccatcctgtggttatttcactatgcagttcgggaatgcgtaattggaatagatacactcagcaactgacacagagaaccaaccatattggttctctgacttgagtgagggctattatagtgggaaagttcaagtggaagccactagaactgcctctacctaggaaaatgataaaccaaaatcaatattgcattcctggaaggatgccagaaattagtgccaccatcaaggtcttaaagtatgcagaaataatttccaccccatccccattcaactcacctgtttggcctttgcagaaaatacgaattttggagaaagacaatggattatcataagcttaactgggtgattactccaaccagaggcagttctattgcttgagcaagttaacacatatcctcatacctggtatgcagctattgatctggcaaatgcttttttctccataccccttagtaaggaccaccagaaacaagtttgttttcagccggcaaggccagcaatacaccttcaccatcctgcctcatgagtatataaactctccaaccatatatcatagtttagtttacaggattttgatcagctttctgttccacaagataccactctggtccaatacgttggtgacattatatcgattggacctatgagcaagaagtagtgacttctctagactcattggtagaatactggcatgtcagaaggtgggaaatctcactaaaattcagggccaccttctacacaggacaatttctaggcatctagtgtgaggcatgtcgagataccctttctaaggttaaggataaattgttgcatctgacgactcctacaagcaagaaagaggcatgatacttagtgtacctctttgagtcttggaggtaaaaaatcatggtaaccatttccagcttggttatggcaactgagtgcctccacgtgccactctgaaatctaattactcccattgaatttaggtttcatttggagcagcacactggggcatgctactccatcctgtttaccaaaagctgctagttctggggcccagaactacacaaggcactgccacaggtccaggctgccagggaagtttctctgctacttgggccatctgatccatcagatccagtggtgcttgaagtggcagtggcagatagagatgctcattggaggctttggcagacccctgtaagtgaatcacaggacaggcccttaggattttggaccgaagccctgccatcatcccctgtgggtaactactctccttttgagaaatagcttttggtttgccttagtagagactgaacacttaaccatgggccaccaaattaccatgtgacttgagttggctgttgtccgactcaacttgccataaaattgagcatgcacagtagcagtccatcatcaaatggaagtgatatatacaaaatcaggctcaagcaaaccctgaaggcacaagtgaccatgaagaagtgacccaaaatcccgaggtctccagttctgctacactgccttttcttccccagcctgcacctatggcctcatggggagttccctatgatcaactgacaggaagaaaaaactcaggcttgtttagtagataattctgtgcagtgtgcaggcaccgcaccccctttctgggacattacctgaacacttttcccttctgtagatgataaggagctgtggacgttttttttgttttgtttgtttttgtttttgtttttgttttaattttgagacagagtttcactctgttgcccaggctggagtgcagtggctcgatcttggctcactgcagcctctgcctcctgggttcaagcgattctcctgcctcaaccttccaagtagctgggactacaggcgcacgccaccacaccgggttaatttttgtatttttggtagagacgggctttcgccatgttggccaggctggtctcaaactcctagcctcaagtgatctgcctgcctcggcctcccaaagtgctgggattacaggtgtgagccactgcccagccagagctgtggaagtcttttaagcaggggttagcttttaggtagatcacattggctgtcataggaagaatggcctgactatgggtttggttccgactttgatctggatcccagatcagggcttagtctggtttttgggtcagacttgggctccagtgcaggaccctgtctgtgtgcctgaggtcagcacggtggcctcaaaatgtgacctgtgtgtttggctgagtttgggtttcccagggtagggtctactgtggtctttgggtcagactgggaccccgaagaagacctggtctgggtgtgtgtcagactggggacccttgggcaggagctgacctgtttgtgtgggctagactggacatcgcagggtaaacctgacctatgtgcctgtacagcttggggatctcaggaaaggacctcacttgtgtttgggactgactggactctagaacccagcctgctacctggattagactggaagcctcaaggatgacctgtgtattaggtctgaataaacttcatgtcaagcttaggctatgtttgggagagactgggcttcagggaagtgcccgcctgtttatttgtttcagactgggtgttgttcagacagggcaggttgtggtctgtatgacttgctctataagactaccttagtgaagccccatacatccagatattagttgggacttcctcaggagttgggaggaggacagagaaaataaaccaagaaggataaataggtaaatgcaattttattactgggggtgaaaacaaagagcattctaagaatttaacaagcaacagttgaccaacagggaacctgctgttgagcccgtaatctgctgaggaaatttgagcctgtccctgagtactgcctgcttatctcttctcagagatcatagccccaactttcgaaggtagtaaagtccctcaccctggcggtttccagtctcatgttctgcagcctctttggcttctccccagccttctgggctgtttccttttcacagagcatcttttctacatgttgctggatctccctagtcctcaccccataaatgacaggattcaaggctcctggaagcagcaagtatatggcactgagtagattctggacattctgggacacagtcttggctactcagaaggtgatggaagtggaaagaccagagacgtagatggagaggatgaccagtaggtgggagccacacgtgtgtaaggccttggcttgggctccccaagaagagatccggaaggcagcatagatgatgtgggtgtaggaggtccccagcagggccatatcagagattacagtgaccaaacacatagccagccccagccagttgttgaaggtcaggtctccacaagctatgctcagcagtgcaatgcactcacaggtgaagtgtcgaatcactgctgtccggcagaatcgggcttttgcagttagtactaccaagggcactgtcactcccaggctctgtgtcaaggcaagaatggccagcagtcccagcagctgggaggtcatcaggtcagaatagcagagtgggtggcagatggctacgtagcagtccagggccatggccagaggaagttgtagtccaggaggagggtgaagtagataaagaacacctaggccaggcggccatgcagcgatatggggttagcataatatacaaagccctccagcattttaggcatcacggctgtggcagcacgaatattgacagccaggagcacagtgatgagcatacacgtaggctgatgcagattttgccgggcaaccactgtgtggatgaccagggcattggcagagatgatggtcacaaagaggaagacaagaggcaggaccagaaggggccaccactctcgaagtccagggaaacccaccaggaagaacttggtgcaggagatgttgaaggtgcttgtatttccatcctcacccattagctttggccctgggccggcaccaagagtggggatcagagactgttagaacaaaatggtcaattttaaaaagactttttctgttgtagacactgaggaatttgtgataaaagcctacttcttcatgtatgtattcctttggggcacagataagtactaagccgggtgttgtaggaactacacagttacctacaatctttgtaggtaacaatctttgtcctcagggagctcttggcctcatgtgtgtgaaatgtaaatgtaaacttacaagatacttgtttacttgtaatgttccagatatttgctcagtaaaagattaggaggagaagtaggtgtagtatacacaggggaaaaagagtgacagccagagacaaaacaagaaaggttaaaagaagactcttgattcagaggaagagaaagtattagaagaatctttgatccaaggagtctgggaaggcccaagtggggcttaacagggagagaagaaccagccgggaatgatggcatcacttgtgtgcttgggacacactgtggcaaggagagatggaagttgctgaggaagaattctggtcttcctggatcacaagaaacaggctgcagagactgcttccttcctaagtcctcgtagattggctgtggtgcctgctgcctggccttgtcctcagtgtcatggatgatgagtttgctttcctttcagaatgtaggttccaggagggcagggataatagcatgcttctggtgggctcactggagctccaagcacagagtcaccatagaggcgcaggacaggcttgagaattgcttgttgagtaggtgcatgaggaacaggaagaagacaataggaggctgaacatttaattgggatcttacagcagttgtttcaaagctttggccaggggccaggactgttctacatacctgatactccacaaactaggcagcattcaacagtcttcaagctttttttttttttttttttaagaggtagggtcttgctattttgcccaggctgtttttgaactcctggactcaagcagccctcttgcctcagcctcccaggcatgagccactgcgcctggtcacttcaagcattctgaatctcagcagcaatatgaagagttagcatttattcagtacttgctacctgccagacatggttccaagtgttttccatgtgatatctctttaatacttgcagaaatcctaagagacaactttagctgtccctttgtatctgcgggagattagttccaggacctgctgtggatatcaaaatctgcagatgctcaagtcccttatataaaatggtgctgggaaaactggatatccatatgcagaagaatgaaactagatgccctacctctcatcctatacaaaaatcaagtcaagatagattaaagacctaaatgtaggacccaaaactataaaactactggaaaaaatatagatcagggaaatgatttagacattggtctgggaaaagactttatgaataacctcaaaagcacaggaaacaaaagaaaaataagcaaatgggattatatcaaattaaaaagcttctgtacagcaaaggaaataatcaacagcgtgaaaagacaacctacagaatgggagaaaatatttgctagctatttatctgacagaggattaatatccagaatatataaggaactcaaatatttcaatagcaacccccccaaaaaacaattgattaaaaatgagcaaatgatctgaacagaaatttctcaaaagaagagataaaagggcaataaatatatgaaaaaatgctcaccatccctaatcattagggaaatacaaatcaaaaccacaatgaggtaggctctcaccccagttaggatggctattatcagaaagacaaaaaaaaaaatgctgcagaggatgcaaagaaaagggaactcacatatactgttgttgggactgtaaactattaataatacaataagctattaataagccactatggagaacagtatggaagttcctcagaaaactacaaatatagctaggtgcagtgacttatgcctgtaaccccaggcactttgggaggctgcggtgggaggatcacttgaatccgggagttcgagaccagcttgggcaacatagcaagaccccatctctacaaaaagtaaaaaaattatctggacctggtggtgtgcacctgtcatcctgactactcaggaggctgaggcaggaagattgcttgagcccaggaggtcgaggctacagtgagctatgatcatgccactgctctccagccttgggtgacagagtgagatcctatctctaaaaacaagcaaaaaacaaacccaaaaaactacaactagagctactatatgatccagtaatccactactgagcgtttatctaaaggaaacaaaatcaatatattgaagagacatctattttaccatgtttattgcagcactattcacaatagccaaaatatggaatcaacctaggtgtctaacaacagatgaatggcacatgtacacaatggaatattattcagccataaaaaggaatgcagtcttgtcattcacagcaatataagtggaagtggaggacatgttaagtaaaataagccaagaacaggaagttaaatactgcatgttctcactcctatgcacaagctaaaaaattgttggtcttggtcttgtagaagtaaaagtagcacagaggacttgaggctggggaaggtagggggaaaggaaggatagggagggatttattaaatatacaacatgacagcaagatagtaggaataagttctagtgttctatacactgtaggatgactacagttaacaatacatggtttcaaatagctaggatagtaaatgttctcaggacaaagaaatgatgtatttgagatgatggatattctaattactcttatctaatcactctccattgtatgtatcaaaacatcaccatgtaccccacaaatatgtacaattatctgtgtcactaaaaaagtttaaaaattacatagagtttacatataatctatgcacatcctcccatatactttaaattgtttccagattacttgtaacacctagtacaatgtaaatgctatgtaaatagttgttataccattttttttttttttttgagacggagtctcactctgtcgcccaggctggagtgcagtggtgcaatctcggctcactgcaacctccgcctcctgggttcttgccattctcctgcctcagcctcccgagtagctgggactacaggcgcctgccagcacgcccagctaattttttgtatttttagtagagacgggttttcactgtgttagccaggatggtctccatctcctgaccttgtgatccgcccacctcggcctcccaaagtgctgggattacaggcgtgagccaccgcacccagctcttatactgtattttaaattttgtatttttttattgttgtattcttgatttttaaatttcttttcgactatttttgatctgcagttggttgaacctacagatgtcagacccatggatatagagggctgcatgcataatactatttattaacccaggttatagctgaagacactgagatttagagaggttaactaatgttcttaaagtatcataggtatacctttaaatgatagggctgggatatgacttagtgacttaggtatgtcaatggtaaaaggtggagttcagctccaatctcaggtttacctctctccaaatcccccataaatttattgttgcctcaccgtggcagcctgcagtagtctccagttgggttgcagcctgctgtgtctttggtttcgcctctgaagagctaaggctggaggtcaggtcagtgcccaactccaaggcactatgaggctgatttatgagggatggaaaattagacctgtggctccaggggagaagcctgaggagattcccagagggtagtcattccaaagggcactcaaaaggaggaaacaaggagaaacccagaagaacccatctgtccctcagagaggaccccaggagagggctgggtggaggtgacagtatccaaatttttttttttttttttttttttttgagacagagtctcactctgttgcctaggctggagtgcagtggtgcaatcttgatctcggctcactgcaacctccacctcttgggttcaagcaattctcctgcctcagcctcccgagtggctgggattacaggtgcctgccaccatgcccagctaatttttgtatttttagtaaagacagggtttcatcatgttggccaggctggtcttgaactcctgacctgaagtgatccacctgcctcagcctcccaaagtgctgggattacaggtgtgagccactgtgccaggccctgtactaacatttttttctctatggctcttggcatttttcacagagcaatcacttctgctaagggatttcccctcttttacagatgagccattagaggctcaggaagagcaagtgaggtttcagaacaagtcccatcccaggggcataaacaggcataatctgtatatcactgactaggatgacctggggctaagctgagggaaggggctcttgcaatttgaaggttaaatggacacttagggggtacccaaagtcaggaaagagctctggggtgacaataggagagcccagtggtcaagacatggatctgatttagggtctgtgtgtgtgtgtgtgtgtatgtgcatgcaagctgcggttggtgaggaatttacttctgggtggttcagaaattagggcagagagtgcagtgtgtactcagctgtgaaaaactgggaaccacagaggcaggggctggctcctccagggaggcatccagtttgtcctctggaatttggaaataggactaaaaaagctcctctttttctctttttttataccttctttggatcttctttttgtgatttcatttactctcctttgttggtttattagttgttcctctttgttgtcttatttcctcttggttgctttagggtttatagtacatatctttaacttaccacagtctatctacaagtactattaagtctttcacaaatagtgtgagatttttacaacacaacgtagctcttgtgtccattttgctttctcatttttatacagttactcattcctttatttttttcttcacatctttactgagcacttactttgtgctaggccatatgctggatgcatggatacaacaataagtaacatttgtgttccctgagtgagtctgcattctactgagtaggctagtaatgacaatcaatggtcaaaatacagcatgtaacagtatactcaacaaatgcatcccaaaatactatctgcttttaacatctaccaagtccaggaaggaccaatgccaggtcagttgaggtcatgtctactcttgagctattctccattcctgtgacttggtgaggtgaaaagccatcagttataaactagggagagaaagaaaagatagggaaaagattaagggacaaatctgactaactcccatttcccaccctgggcgtccaatttgaaggaggcacaggtggtgggggtggtgttggggcaacctctaatttcaatgtttggggcttttatagttaggtgggtgtggctatttgaatggttaatatgaggtggtctttgaaattaaaagtgacccaaggactttttaatattttttaaggaattaacaaagtcatattagaaacttcttgagattttgtccaaggagcagcacagatcatacctgaatggagaacaggcagaaaaagtaagctgttctggtgctccttttggagcatcgcttttccaaagcaatggtgtaagaagagctacagggccaggcacagtgactctcgtctgtaattctagcactttggtaatctgaggtggtaggattgcttgagatccaggagtttgaaagtaacctggacaatataatgggacactgtctctatagaaaataataaagaaaattagctgggtgtcgtggtgcacacttacagtcccagcttctcaggaagctgaggtgggaggattgcttgagcccaggagattgtggctgcagtgagccatgaacaagagattcaggagcatggtggatgaagatctgactgtgcctggtgtaggttgggagaggaatgagagaatgatgtattagggaaaatcaagcccagtaatgctttactgagttcaagtatgttaggttcttccagttttagcaagtgcataaaaatggaactgatatgtagatatctagagatatttgaaaggaaccaacttcaagttgaacaatctgtaatcgacattagcctttttccctttccttttttcagtcttcagatttttccaaagatttcttatgaatgtactgcagagaaatcccaaacccatgttcaaattcttccagtaagtgtaagtactttgtctaggcaagagatttgaattttactggcattgccagatgctctcttataatctcttaccatgatagggaaggggctttagttctttcagacatccttgttatgccttttctggttttaagctattttctcatgatatggggatacaaataaagtgggagatgagcaatttctttgttctttcttaatattactcacctgcccaagatctagagagcccttctgttttctttcccctttccttcattccaataacttattgaaaaccccattctggcccactcagactgcagccctccccacagcccttctgaggctgtcttggaggtgcaaggtcagagtatgaagtggggaccctgtacccaaagcttaggcagacaccctagtctagggcttgggctttcacaggcaagtatagagtcaaaaagaaatgagaaacggcctagatctcaataaatgtttggtggtggacaatcacagggataaaaagcctttgttcttccctggtccccacctgggatcataagatcagagaaccaagaactcagagactcaagaatgagagaatctaagaatcatttagaagaaaactttacaaagcaaacctgccagcattggatatgggaaggaaacgagaggagaaggcaaagattccttctccccacctataatgccatacaaagcacttttctagttttaagctgctatgtgaagtagcttactgtgtatgattactaagagaatttacaggtactgaaaacattttggggagccttcaaaccctgtgcccacctttgcccctacattactaaggtgaaagcctcccccaagccttctgcttgaccaagcattaacttcattactcaccaggacttacacagactgagagtagtaggaccagtctgctccaggcctgggtttcttgaatgcagttaaatccatcccattcctccctgtgggaagttgccagagctttctcccaggctctggcttagctcagcagggtcccaggggtagccagaatgtgaacacatcccctcaggcccttgtgggctggaggaacagcatgagcaggagcagggccttgagatgggcatattagggggccagtgatgaggggtcctgtttgggggaatagaaagatttttatctagcatttctctgtaattctttgctccttcaccctacattcttctgggtgacttcactctcttcatggctcccatctttacctgggcacctgtgactcacatgtttctacctacaggccagatgttgcccctgcatctcagagccatgtatccaatagcctgtcagtcaggggaacctcatgcctcaggggaacctcaaacatacatgccccaagctgaattcatgtcttcacaatggcatgttttctccctgttttctttttttcgaagtagtgtttatttttattttttaaataacagctttattgagatagagcccatgtaccataaaatttacccttttaaagtgctttttagtatactcacatggttttacaaccttcacaattaccttattttagaacattttcatcacccccaaaagaaactgtaacccattagcagtcattcctcagcctccccttctccaaaacctcagaaaccaccaattcactttctgtctccacaggtttgcttattctggacattcatataaacagaatcgtacaacagaatggaatcatttagcatgatgttttcaaggtccattcatgtaacatgtatcagtattttattccttgtcacagatgaataatattctatcatatggatataccacatactatttatccattcatcatttgatggacatttgggttgtttccacttttttactgttatgaataatgctgccatgaacattcatatacaagtttttatgtggacatgttttctttctctaaaaatttttaaatctatgttttaaatcgagaagtaaaagatgtatatatttatggatatatgttttcaattatttgggtatatacctaggagtgacatttctaggtcacatggtaactctatgtttaacattctgaaaaactgccaaactgttttccaacgtggctgcagcattttatatacccaccagaagcgtatgagagttctcatttctgcacatccttaccaacatttgttattgtctctttttaattttagccatcgtggtgaagtgatatctcattataattttaatttgcatttctctgatggctaccgatgttgagcatcctttcatatgctttctggccatttagcttctttagagaaactattcaaatcctttggccatttttcaattgggttatttgtccttttattgttaaggtgtaagtgttgttatattttctggatagtagacccttattggatataggatttgcaaatgttttatgccattctgtgcattatcttttcattttcttgctggtgtcctttgcagtactaaaatttttacttttgatgaagtccagtttatctatttttttctttttcttttgtgcttttgctgtcacatataaaaaactattggctaatttgaggtcacaaaaatttacttccatgttttcttctaaaagttttatagttttagctcttacgtctacaacctattttgagttagtttttgtatatgatgtgaggaaggggtccagctttattcttctgcgtgtggatatacagttgtccagcgtccgtttgttgaacaggctattctttccccatcaagctgttttggtaccctcatcattccctgtattctttaccttagtgatcttctatgctttatcttagggatgctgttactatctcttagtggggaaatctgcattctgcagagatttgtctcctccctttgctaggtcttttctaggctaaactagaaagtttgcttatatggtcctggagatggagggatgagatgcttgatttctcatgccttctgtcctgtctggccaatatttctgtggatgcctttttctctccaacctcactgttactgccctgttctgggtcacatcttttctagcctggctggcttagtgcctcttagtccatctgttccctctcctctcctcattcccaacccaaactcagctcaaactgagagaagacctattgaacattacttttcaaagtatctgctaactagttggatgaaacatggtattttattacatatctaaaactggttataattaatgttggccattgttaccatatgtgtctggtgggtcctttttctttctttttaaaaattagcagactgcttatcttttatctacttattagaaggcagcattgtatattctggcttaaatctcctctttggaattctgctgattccaaaataaaggccgactacttagcagagaatagacagtcctcttagctctggtttatgcctggctctctagcatcatttcctatatattagcaggcaagatagagatggaaagggagtgggagggggcctgggccagacatgctaatttcagagagtggctcgggtcctggaaaggaaggtggaatacttgggggtcttggattcagtaaccacacatagtgaagaagggagtctcagtgggtcctgagtcctgtgtgtggggcctatatcatgaggctgtggaggggagggctgcttccatggtacttagggcttggtcaaggcacagtggatgtggaacccggcttgtaggacctcacaggaacccaagcctgactgggagtgacacagttcttgacctgcttcagggtgggccaggggcttcccagtctgcacttagtggacacagctggacaaggtgaagcagtgggtatagagagaggctgactgcatcagcgtcccaggaccctctgccacatcagctttctttaggagccctagaagagcccaccctttctgatctccaaaaatgtgctttatattccacttccttaaatcttcatgttactagtcagagaagttgtaacttctatttatttatttttattgcggtaaaaaataacatgagattgggtcgtgcgcggtggctcatgcccaccgcgttatcccaaaggtgggattacgcctgtaatcccagcactttgggaggtagaggcaggcagatcacgaggtcaagagatagagaccatcctggccaacatggtgaaaccccgtctctactaaaaatacaaaaaaattagctgggcatggtggcatgcacctgtagtcccagctactcaggaggctgaggcaggagaatcacttgaactcaggtggcagaggttgcagtgagccgagattatgccactgcactccagcctggtgacagagcgagactccatctccaaaaaaaaaaaaaagagattaaccctcttaattaagtgtacagtaaagtattgtttactaaaagtacaatattttgtagcatatctctagaaccttttcatcttgcataactaaaactttatacccaactgaaaagcaactccccattttcccctctccctagtccctggcaactaccattctaccatctgtttctatgagtctgactaaaagatacttcatgtaagtggaatcatgcagcatttatttttctgtgactggcttatttcactcagcatagtgtcctcaagtgtcatctatgttgtagcatatgacaggattttcttttttaatgactgaatattctatttctatttctttttcttttttttggggatggagtcttgctctatcacccaggctggagtgcactggtgcgatcttggcttactgcaacctccacctcacaggttcaagagattctcttgcttcagcctcccgagtagctgggactataggtgtgtgcaccatgtctggctaatttctgtatttttagtagagacagggttttaccattttgggctggctggtcttgaactcttgacttcaggtgatccacccaccttggcctcccaaagtgttgggattataggtgtgagctactgtacctggcctgaatattctacttcttgatagaaaaaaacagactctgtaaaatatttgaagagggttatcctgagaacatgtgcccaaggtggttgggttgagcttggttttatacattttagggagacagatgttattggtggggggagcagttgtgtgggggttgccaggtcataggtggattcaaagatttcctgattggcaattggttgaaaaggttaagctttgcctaaagagttgaagtcagcagaaagaaatgcttgaattaaggggggttgtggaagccaaggttcttgttatgtagataaagcttctaagtaacaggcctcagagaggatagatggagcttctgaacagcaaaagaaactaccatcagagtgaacaggcaatctacaaaatgggagaaaattttcgcaacctactcatctgacaaagggctaatatccagaatctacaatgaactcaaacaaatttacaagaaaaaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcatgaaacaacaggtgctggagaggatgtggagaagtaggaacacttttacactgttggtgggactgtaaactagttcaaccattgtggaagtcagtgtggcgattcctcagggatctagaactaaaaatgccatttgacccagccatcccattactgggtatatacccaaaggactataaatcatgctgctataaagacacatgcacacgtatgtttattgtggcactattcacaatagcaaagacttggaaccaacccaaatgtccaataatgatagactggatgaagaaaatgtggcacatatacaccatggaatactatgcagccataaaaaatgatgagttcatctcctttgtagggacatggatgaaattggaaatcatcattctcagtaaactatcgcaaggacaaaaaaccaaacaccacatgttctcactcgtagaagggaattgaacaatgagaacacatggacacaggaagggggccatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtttaataataataaaaaaagaaaaataaaaaaaatcaaagaaaatctaaaaaaaaaacaaaaaaaaccccaaaaaacaaaaaaacaaacaaaatacatctcttattggcctttaaaaggtgtcaggctctctggaaaatacctagtaaagggaagagatgactctctacagaacggagatttccccactaagagacagctttgcaaggtcacttcaaaatacgtcaaaggaaatatattttggggtaaaatactttgatttccttcagggcctaccatctgtcaagtgatgctataccagagtctggagttggatctacaaagagtagagtctatttgctacaaagagtctattttttcagtcttatgatctctattttaatgtgaatgctggtcagttgtacctaaactctaaagggagaagggtataaccaggcatgtctgatccccacttctcatcatggcctgaactagcttttcaggtttctttgggatccccttggtcaagagagggctccattcagtgagttgggggcttagatttttatttttgggtttacacattgcacatacatcatattttctttatctgttcatttattcatggacatttaggttctttccacctcttgctattgtgaataatgctgcaataaacatgagagtgcagatatctctctaatatcttgatttcaattcttttgggtaaatacccagatgtaggactgttggatgatatggtagctctatattaaatttgaggcttcgtaacttttaatgtttcctgctgtgccatgtatttttcctttgtccctccagatctacttgctatcttttccattctgctgtctgcctgtttcaggaagactgcatcagcacattaccttgcctgctggctttcagtggcttcagccaaatttcactccccactagagtaggaggttgggagaacactgaggtcagggagttggttcccctggctccctctctgccaggtcacagattccttgctgaagaccacatccctggttgggtgacgtttttctatcactactttttgggtttctgtgtctactctctccatttgaccctcagatcatggggtggtcctggctctttgctgtgcaaattcaagggtgctgccctgtccctcattggcttacttaatcccatctgtgtttataaatagtccctcattatactctccccaattatcctctttgagtgtcccgtctctgtccttctgggccctgacaatcagagatggtggacatatcctaaacccaatgaatggttataccttttctggctcaagtcgctattttctgtccatccttggtgcttggtgacacttctccaatccttgaagcagaggtcttctctgatcttatcatagtggtctttacttatcagcaaacatcagaggtaaacaatcagcctcatgggaagagggaggttgtttcttcccagggtagcctgtggcctctgctgtttcagttgtggtagttcttgaagcctgttatctgaagtcaccagcatttactttaaataaaacacaaactctctagcttagctccaaggcctttcaaaatgtgatgccagaccatctcttcaatacttgtgtctttctctacatctgttctactgtgttttacccaaacttatctattattcatgtagcaggcagaataatgacccacttcccctaaagatgcccatgttctacttccctgggaatatgaagaaagcggaggtcagagtcatgtgcttgctggcactgaagatgaagaaagatgggggaagaggacaccagacaaggaatctgggcagcctctggaagcagctaaaggcaaggaaacaggttctcccctaagtcctccagaaaggaatgcaaatcctgccgacaccttggttttagcccagtgaaacttactttggacttttgaccttcagaactgtatgataataaatttgtgttgttttaagctaccaagctggtaataatttgttacagtaacaacaggaaactaatatattccctaaatgctcatcccattctcaatataagccagtggttctcaatcttggtttacattagaatcacctaggaagccttaaaaaaataccaggacctggaccctgtctccaaagattctgatttccttaatgtctgaacattagtgtttttaaaaaagctacccaggaaactctaatataattggaaaccattgatctagacctttactcaatgctgtctcctctacaggaaatgattttctttctagcttgaagatttcaacttgggatgcccagtagaaactctagaggagtttttaaacagcaccattgtactgccaggactccattcctagaaagtctggttaaattggtctgaagtggggccaataattgattatttttttaactcttattttagtttcagggttacatgtgcaggtttgttatataggtaaattgtgtgtcatgggggtttggcatacagagtattttgtcacccagggaataagcatagtactcgataggtagtttttcagttctcgttctcctcccaccctccaccctcaagtaggacctgctgtctactgttgccatctttgtgtacaggagtacctgatgtttagctcctacttataagtgattacatgtggtatttagttttctgttcctgtgttactttggttaggataatggtctgtagctgcatccatgtttctggaaaggacattatttcattctttttttatggctgcatagtattccatggtatatatgtaccacattttctttatctagtataatgttgacgggcatctaggttgattctatgtctttactattgtgaatagtgctgcaatgaacatatgtatgtatgtgtctttatggtagaacaaatttttattcctttgggtatatacccaataatggggttgctgtactaaatggtagttataagttctttgagaaatctccaaactgctttccacagtggctgaactaatttacattcccaccagcagtgtataagtgttcccttttctgcagaagcttgccagcatctgttattttttaaattttattttattattttttgagacaaggtcttggtctgtcacccaggctagattgcagcctcaatctcctgggctcaatagagcctcccacctcagcctcctgaggtgctgggactacaggtgcacaccacactccctggtaatttttgtattttttgtagagaggaggttttgccatgttgcccaggctggtctcaaactcctgggctcaagcaatccacccactttggcctcccaaagtgctgggattataggtgtgagccactgtgcctggcctcttttggaactatcgttatgaagttttggaatagcagttatgctagtttcataatgaattcactcaatttcctaattaaatatcatgttctaggatagttttttatagcacaggaatttttcatcttttgaaagtttgggaagaacttactcataaaacctgggtccaggtgtctttcaggtaataattatttattaatgctttttgatttctttcttggtaattaatctactcaggtttttaatcttttcttaagtaaatttgaaaaattatatccttctggagatttgtctatttcataaagaattataaatttatcagcatagactcctacagggtgatttgcatttcaaccaggcaattaaataccttaacccaaataataaatctgtaatgctggtaatattttgagtcatgctccacctagctcatctcaaatcactctgtggtgtaaaaggcatttctttacagtatgtatgaaaataccatatacacactcactaaaatactcaagagacacacactccataaacacaccatcttctggagaagtggttctaccacagactgaatcccataacaaaaatattgcttctgtcctcactgctcagaccccactcttgctagtcatttgcctcactgacttatcaaaaactcagatgatgaagggttaggatctcagaaacataggccatcagaggaagaagattttatttttgtctgcacacaaggaatttaaggaagagaggaactgcaaatctgctggtagctgaaggtggtggtagccacgatccctacatgctcagcactagggcagatgggctcctcttcccatcctttttggggcctctaggacaatgtagaacatccagaatcacgaattcacaggaaccaagaacagcaacatattcacagccatatacagcagaggtctgtagaggtcaccttgctcggctcctgcctggatatgagctccctcaacttgcatgtctctagagatgagttgctcactactgtgtgttgaggccgtcagttttgtgagtgggtggctttacccagatgtctttccttactgagggctgaatctctcttcgtgtggtgtcatctccttggttctaggtctgtccccaagagcttcttggggttgttttaataggaaggagcagaggagaattaacatatttttgagggcctaccatttcttggccctgtgaagtactttcaccgctacaatttccccctcattcagcagccccaacccctctattattagacaggcattagaactgagcatcaggcacatgaggtcatcttttacccttccatttatttgttcattcaccatcgtttttgacatttgttatgtaccaggcagtctgccaggcactgaggcttaatgggctcactagatgtggtttctgtgcccaagttacttagagtccaatggagaagaaccagagtgctgtgggagcccagaggaggtctctaattcagcctccagagacaagccagtcttttaagaggaaaggatctctaatctgagaatcaacattcaagtcagccagggcaagtgcagtacaaagagctcaatgacatcaagctgagaattggtggggataggattagaactccaaagccaagtgccctttcactgtcacctcacctcaagggaggtatctgggcttgggtaagtcccataaacaaattatagaaagaaacaagatgggagagtgaaagtgagaggatgaactcacattcctgctcatttttcactgtggatgactcgggttcaaaaaggagggctagaggttaggcttaggaaaagattttctcccgagaagaccaggagctggggaggaagggaccctggtgtggactgggggtagtggtgggattgtccagagagagaggctaaccagcttgcggtgtgagtcaccctctttccttgggctttccctgcatatcccctactcctgccatcacctgcctagtaagagcctccaccctagtggccctcactgctctcctgggctgacctccagagctgatactcaccctagcaacatcaagcaggaacacagagaaccagtggggctccctaagtgtggttaaatgcacccctacttttccccaggggagcacaggctctgcctcagccaatgggcaatgaccttgagcaagagctggctgcctaactcagtctcctaggaagtgaacaggaccagcctggagtctggtctcctgacagccaggccaggcccttcctactggtctgtgttgcctaaggtatctgctctggagctgaagattcaacaaagacagagaattcacacctcataccctaaacctgcagcccaccccaggggcagctctgcccaaagcaggatcagggagtggactgtgggatctcagtcaatccagcaggtgggttctaaatatcggaaatgaggagccaagagttccaaggaagtgcaactttgactgagcacttactatgtgaggatttttgaaggatcagtggtacttctatgatgtttgtgggagaaggcggggagctggaagaaggagaatgaggctttgagagagcctgttgaagtgaggatgttatcatcccattttagaagtaggcatcgagggttagagaatttgggtgacttgttcaaggtcactcagcatatctgtggcaatgctgggatggtcatctgatccaaatctggctttctctactcacacctctgtctcacccctgctctaggccctggggaggaacagataggattcaatgatggcttcatggaggagaggacatttgggccaggcctggaaggtctggaagcagacacccaagcagaaaggaggagggcctggatggctgaggctgagctcaacatgtgggatacggactgtgatgccggcaggtgtggggctggtgaggtttgtcctgaagtcttggaagttggggagggcaggagccaaataagagtgtgaagtctggatccctggagatcctccaagggcaccggatgggtatgcttcagctttgtggctgaggtggcagcagggtggtcagagcggtccagcaggcaaccagggatggaggccccggaagaatgtggagcaccccagggactgctcacccctgggcccagctgtgaggtttgccaagaggagggatccctcatgctgggtgaggcctcaggtgaccctctgtgactccactctctcctcttccctgggcctggcctgtgcctttctcactgggctctgtggtcccctccagttctcccatgatcctccggtcagtaggggcctggccagggcacagacacccatgcaaaggtggcttctcacctcttggccctggcatggaccccactgctgccccagaatggtggtggctttcactggacacaccacttggtcacctcacaccaaggccaactcagacctccaagaattgtttgccttctcttcttaaggctctgtattagtttcctagggctgccatcacaaattgtcacaaagtgggtgcttaaatcaacagaaatgtcttatcccatggttctggtggctggaagtccaacattaaggtgttttcagggccacactccctccggaggctctagaggagaatccgcgcctggctgctcccaggttctggtgcctctggcattccttggattgcatccagtctccacctgcatcttcccatggcctcttttccatctctcatagggacatttgccattggatttagcgttcatctaggtaatctagggtgatctcatctgaagatccttaattacatctgcaaagacctttttctaagatagggcatgttcacagtctccaagggatgggacatggacatatctttgtgagagccacccctctgcctaccacagcctccaaatgtggattgtgaaggaatgagagagagagggaaaggggcagtgagggtggccttggccttggcaggttggtgtgcagagggccgtagtaggggtgggtgtgtgacaatcacaatgcgggaagcaagggtgctgctatcaggaagcctgtctggtctggtcatagcatccttgactccaatggttcagctcagaagggtgggaactcagctctgcctgtggggctgggctaagccagaaaggctccctggggtagatgagcttcaagtctttcctgaggaaagaccagctgaggggtgcagagagagcgtacaggctgaagagatgctactcaggccttttttcatgctaggagatcccagctgtgcctcttgtcaggtctagggcttttcagggcagggatgggcctcccccctcaactggggagaccctttcacagaggcaacgtctggggccagggtaaggttgtggctgcggagcacagaggggaggccccaaaggtcctcaccaggactccatggcagggacagccagggaagggagacatgaggcaggcacacatgtctcaagggcaatgtggccgccactagccctgctcccactgtcccatgcctcgtcaactcctcttttccatctcctgtcaagtgagtccaccccacgtaccaaggcaggttccaggacacgaccctgctcgcccctctccctcacaccctcatcttgttggacaccaaccctgcccatcccactgccaagctcctctcttgtctagctcctaaggcctttgtctcaggtcatctccaggcctcatgctgggccaggacccaccactccctccagcccctgtctaactctgcctccagaaggatctttcaagaaagcaaacctgaccttgtcaccctattaagaccctgcagaagctccccactgcccaccagataaagtgcaggctctctcactgggcattcaagtctctcatccgccacccctcccaggggtgcctctccagcaaggccaaactgcttgtactctgctgcccatccttctgtttgacctgtctttcctctcttagcttcacatgatactgcttgtgcttgctctaggacctcagatgccaccaactccaggaaggcctccctgagtgctcttgcccgctccaagtagctgcagcatgaggagtatcttgagtttgggactcacactgcatcccactgtggaggacactctgggcagcccagctggcctgcaactgccttagcagtccctacccccagcccagcactatggggcagaccacttgtctactgtctctccttcccttctccttcctggcccccatggcatccctgccctaacttctcctcctcagatttttctttctgtatcaagatggtcaggggcctcatattctctgtcccttctttatgtcagaacctgctctccagtgggatctgaagctccttcacacttatgcacaaaagcctgataatggctgtagttgactcctggaggaacagtggtggttattttggcacatggagtgggtggggaggttttttgggcacaggaatcttcttatcttcttgaagtccctgaaatctgtcttgggtgcatcatctattctttattttttaattaaaaatttttaattgaaggctgggtgtggtggctcatgcctgtaatcccaacactgtgggaggctgaggcgggcagatcacctaaggtcaggagttcaagatcagcctggccgacatggcgaaacagcgtctctactaaaaatacaaaaattagctggatgtggtggcgcacatctgtaattccagatactcaggaggatgaggcaggagaattgcttgaactttggaggcagaggtttcagtgagccaagatcgcaccactgcactccagcctgggtgacagaatgagtcttcgtctcaaaaaacaatttttttaattgatacataatatttgcatatatttatggggtacacatggtattttgttacatgcatagaatgtgtaacgatcaagtcagggtatttggggtatccattatcttgagaatttataattttcatatgttggaaacatttcaagtccttttttctagtaattttgatatatacaatacattgttgccaactataatcactcttgtttgctatggaactaatttcttctgtctaactgtatgtttatacccaataaccaccctctctttatctcactgccctgcacttaccagcctctggtaactgtcattctactctctactttcatgagattaacttttttagctgtcatgtatgagtgagaacatatgatatttgcctttctatgcctggcttattttacttaacttaatgaccttcagttccatccatgttgccacaaaagacatgatctcattcttttttatggctgaatactattctgctgtgtatatatacacaccacattttctttatccaatcattcattgatggacacttaggttgaatctatagttttccttctgtgaatagtgctgcaataaacatgcaagggcaggtatcttttttgatgtgacttcttttcctttgggtagatactcagtagtgtgacagatagactaaatggtgttcttatttttagttctttgagaaatctccatactgttttccatagaggttgtactaacttacatcctcaccaacagtgtatgagttctctttcctccacattctcaccaacatctgtttttttaaaaatcttttttatgatagccattctgagtggtgtaacatgatctcttgtggctttaatttgcatttcttggatgattagcgatgttgaggattttttcatatgtctattggccatttgtatttctttttttttttaaaatgtttactgatgttctttgcccactttttaaaaaaattattatactttaagttttagggtacatgtgcacattgtgcaggttagttacatatgtatacatgtgccatgctggtgcgctgcacccactaactcgtcatctagcattaggtatatctcccaatgctatccctcccctctccccccaccccacaacagtccccagagtgtgatattccccttcctgtgtccatgtgctctcattgttcaattcctacctatgagtgagaatatgtggtgtttggttttttgttcttgtgatagtttactgagaatgatgatttccaatttcatccatgtccctgcaaaggacatgagctcatcattttttatggctgcatagtattccatggtgtatatgtgccacattttcttaatccagtctatcattgttggacatttgggttggttccaagtctttgctatcgtgaataatgccacaataaacatacgtgtgcatgtgtctttatagcagcatgatttatagtcctttgggttatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgctggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagcaggttgcgaaaattttctcccattttgtaggttgcctgttcactctgatggtagtttcttttgctgtgcagaagctctttagtttaattagatcccatttgtctattttggcttttgttgccattgcttttggtgttttagacatgaagtccttgcccatgcctatgtcctgaatgataatgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttgattccatatgaactttaaagtagtttttttccaattctgtgaagaaagtcattggtagcttgatggggatggcattgaatctgtaaattaccttgggcagtatggccattttcacgatattgattcttcctacccacgagcatggaatgttcttccatttgtttgtgtcctcttttatttccttgagcagtggtttgtagttctccttgaagaggtccttcacatcccttgtaagttggattcctaggtattttattctctttgaagctattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgcgtttgtcatagatagctcttattattttgaaatacgtcccatcaatacctaatttattgagagtttttagcatgaagtgttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcgttttgccagtattttattgaggatttttgtatcaatgttcatcaaggatattggtctgaaattctctttttctgttgtgtctctgcctggctttggtatcagaatgatgctggcctcataaaatgagttagggaggattccctctttttctattgattggaatagtttcagaaggaatggtaccagttcctccttgtacctgtggtagaattcggctgtgaatccatctggtcctggactctttttggttggtaagctattgattattgccacaatttcagctcctgttattggtctattcagagattcaacttcttcctggtttagtcttgggagagtgtatatgtcgaggaatttatccatttcttctagattttctagttgatttgcgtagaggtgtttgtagtattctctgatggtagtttgtatttctgtgggatcggtggtgatatcccctttatcattttttattgcgtctatttgattcttctctttttttctttattagtcttgctagcggtctatcaattttgttgatcctttcaaaaaaccagctcctggattcattaattttttgaagagttttttgtgtctctatttccttcagttctgctctgattttagttatttcttgacttctgctagcttttgaatgtgtttgctcttgctttcctagttcctttaattgtgatgttagggtgtcaattttggatctttcctgctttctcttgtgggcatttagtgctataaatttccctttacacactgctttgaatgcgtcccagagattctggtatgttgggtctttgttctcgttggtttcaaagaacatctttatttctgccttcatttcattatgtacccagtagtcattcaggagcaggttgttcagtttccatgtagttgagcggttttgagtgagattcttaatcctgagttctagtttgattgcactgtggtctgagagacagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccacttggtgcagagctgagttcaattcctgggtatccttgttgactttctgtcttgttgatctgtctaatgttgacagtggggtgttaaagtctcccgttattaatgtgtgggagtctaagtctctttgtaggtcactcaggacttgctttatgaatctgggtgctcctgtattaggtgcatatatatttaggatagttagctcttcttgttgaattgatccctttaccattatgtaatggccttctttgtctcttttgatctttgttggtttaaagtctgttttatcagagactaggattgcaacccatgcctttttttgttttccatttgcttggtagatcttcctccatccttttattttgagcctatgtgtgtctctgcacttgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcattagttgatgcagtttcttcctagtctcgatggtctttacattttggcatgattttgcagcagctggtactggttgttcctttccatatttagtgcttccttcaggagctcttgtagggcaggcctggtggtgacaaaatctctcagcatttgcttgtctgtaaagtattttatttctccttcgcttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaagttggttccattctccccatcactttcaggtacaccaatcagacgtagatttggtcttttcacatcgtcccatatttcttggaggctttgctcatttctttttattcttttttctctaaacttcccttctcgcttcatttcattcatttcatcttccatcgctgataccctttcttccagttgattgcatcggctcctgaggcttctgcagtcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcatcaaagtcattctccatccagctttgttccgttgctggtgaggaactgcgttcctttggaggaggagaggtgctctgcttttcagagtttccagtttttctgttctgttttttccccatctttgtggttttatctacttttggtctttgatgatggtgatgtacagatgggtttttgctgtggatgtcctttctgtttgttagttttccttctaacagacaggaccctcagctgcaggtctgttggaataccctgccgtgtgaggtgtcagtgtgcccctgctggggggtgcctcccagttaggctgctcgggagtcaggggtcagggacccacttgaggaggcagtctgcccgttctcagatctccagctgcgtgctgggagaaccactgctctcttcaaagctgtcagacaggaacatttaagtctgcagaagtaactgctgtctttttgtttgtctgtgccctgcccccagaggtggagcctacagaggcaggcaggcctccttgagctatggtgggctccacccagttccagcttccaggctgctttgtttacctaatcaagcctgggtaatggcaggcgccccgcccccagcctcgctgccgccttgcagtttgatctcagactgctgtgctagcaatcagcgagactccgtgggtgtaggaccctccgagccaggtgtgggatataatctggtggtgcgccgttttttaagcccgtcggaaaaacggagtattcgggtgggagtgacccgattttccaggtgctgtccgtcacccctttctttgactgggaaagggaactaactccctgaccccttgcgcttcccaagtgaggcaatgcctcaccctgcttcggctcgcgcacggtgcgcgcacccactgacctgcgcccactgtctggcactccctagtgagatgaacccggtacctcagatggaaatgcggaaatcacccgtcttctgcgtcgctcacgctgggagctgtagacgggagctgttcctattcggccatcttggctcctccccactttgcccacttttaaatgaggttatttgttttcttactgctgagctgtttgaattccttggatattctcgggatattagttctttgttggatgaataatttgtaaatattttatcccaatcaggaggtcgtctcttcactttattgattgtttccttcgctgcacagaaactttttagtttaatatagtcccatttgtctagttttgtttttgttgcctatgcttttgatgtcttagccataaaatctttgcctacaccaaagtcctaaagtgtttccctgtgctttatgctttcttctattggttttataattttgggtgttacgtttaagtctttaatccatcctgagttgattttttgtatagtgagaaatagggtctagtttcattctttcacatatggatatccaactttcccagcactgtttattcaagagactgtccttcaatgtatattcttggcacttttgttggaaatcattggctgtaaacacatgcatgtatttctggattctctattctgttttattgttctatgtgtctgtttttattccaatagcatgctgctttggttaatatagctttgtgatatattctgaagtcagctagtgtgaaactttcggctttgttgtttttgctcaggattgctttggctatttaggctcctttttggttccagaatagttttagtgttgttttttctatttctgtcaaaactgacattggtattttgatagtgattgccttgaatctgtggtttttttgggcagtgtggtcatcttttttttttttttttttttttttttttagatggagtctcactcccgttgctcaggctggagtgcagtggcacaatcttggctcactgcaacctccacctctcaggttcaagcgattctccttcctcagcctcctgagtagctgggattacaggtgtgtgccaccatgcctggctaactttgtatttttaatagagatggggtttcaccatgttggccaggctggtcttgaactcctgacctcaggtgatccacctgcctcggcttcccaaagtgttaggattacaggtgtgagccaccgtgcccggccagtatagtcatcttaaggacatcaattattttgatttaagaacataggctctctttccatttgtttgtgtcctctttaatttatttcatcagtgttttgtagttttccttgttttttgcctcacgattaaatttattcctaggtattttattttatttttaaaagcttgttttcttttttaattggcatataataatagtacatatttatggaatcccaagttatgttttgatacatacagtgtagactttttcttccactaattttggttttggttttctcttgcttttctcattccttgaggtgcattgttagattatttgaattctttccacttttttgatgtaggcatttattgctataaactaccatttagcactgcttttgctgtatcccatagattttggtatgttgtgttttgattttcatttgtttcaagaaattttttgatttccttttaaatttcttttttgatccaatggccattcagggacatgttgtttaatttccatatatttgtgcagtttccaacattcctcttgttattaacttctggttttattttattgtggtctgagaaggtacttcatatgattttgatatttaaaaatttgtggagacttgttttgtgtgctaacatatggtttatcctggagcatgttccatatgctgatgagaagaatgtgtgttttgtagctgttggatgaaatgtcctgtaaatttttgttaggtatatttggtataatgtgcagttttaattcaatgtttctttgttaattttctgtctagatcaggggtgtccaatttcttggcttccctaaggcacattggaaaaagaattgtcttgagccacacataaaatacagtaacactaacgaatagctgatgagcttaaaataaattgcaaaagctctcattatgttttaagaaagtttatgaatttgtgttgagctgcattcaaagccatcctgggctgcatgtggcctgcaggccataggttgaacaagcttggtctagataatctgtttaatgctgagagtggggtgttgaagttcacaactcttattgtactggagtctacttctttctttacatctaataatatttgctttatatatctgggtgctctgatgttgggtgcatatatgtttagaattgttatattcttttgccaaattgatccctttatcattatataatgattgtctttatctctttttattgtttttgacttaaagtctgtcttatctcttatatgtacagctattcctgcttgcctttggttttcatttgcatggacttttttcatccctttagtttaaatctatatgtgtctttatacataaggtgagtttcttttaggaagcatatagttgggtcatgttttttaattcatttagccagtctttgtcttttatttggaaagtttaatctgtttgtattcaaggttattattgatacatgattttattaaataatttctggtggctgcattgggcttgggaggccagtccctaggcacatagtgcgtacgtatgtgtgggtgtcagctgtggtggtagaggcaggttgggtgggcctgatctcaggccctgggaaagtgtttgggtgccaaaggtgatgaactgggttgggtgattcccatacccaaagatgacatgcttaggcactgggaaggaggagtggagccaggcctggctccttaggccccttagtagtgtgtgtaggcactggctgtgttaggcagaggcaggtgatccctaggctcctggtggtatgttggggtggaggtgtcactgccaccctgctactggggagcacagggttgctttcagtggcagcagcagtaggcagggagctggggagcatgcactttgcttgtgctttggcagcagtaggcagggagctggggagcatgcactttgcttgtgctttggcagcagtaggcagggagctggggagcatgcactttgcttgtgctttggcagcagtaggcagggagctggggagcatgcactttgcttgtgctttggcagtggcagtggctgtggggcaggggagtctgtcctcagggcttgtgaaatgcatagtaactgctgctgggggcactggaatccgtgccaatggcttctgttttgaccctgggatcatccagcagctgcagaggctgtaggttgggtagcctttcctcaggccatatgaaatgtactgtcacccctctgttgggggtggggggtggagttgcaagctgatgctctcagtcaaccccttcctctgctaaccattggtttgcaggctgcataatccactctaactttgggcaggacttctaagagcttctaatctgtaactcctttttgtacaccaaccccaaccacccagccttgggaaactgagtgtacaaggcctcagcctgggtacaccgaaaggaagcagagaggagaagcgagtcaagaagcttgagatctgacacaggttctggcaagtgcccttgggccagggactcttatttcctcttccatagaaggtagatgttggactggtggcttctcatggcctttcccttcctgcatcaaacttgtgatgtttctagtgaattttgtatgattgtagtttgggaagctctttcatgttccccaattgacttgatttttcgaacacttgggaggtaggtggtaccaacccactttacagatgagggaactgagctttggagtgagcaatctcatagccagttggtaacagaaccaggtctggagttggccccctgactcctatctcctgagttcaccctgattgctgggagctggaggagcttttggcactgggggcagattgttttctccaaatgaggcaggcatgggaccaggacaagccaggtctcctctcctcttgcccaccctactcactcaggctaatacctcctatcctgctgtatctagtcttaaaaatgggtctctgtcccctcagggggatcctctggcctctccaaccttagctgctcttctaggaaagtgggccaaagaaaatttctggtttggtttgcatgtgtcccccaaagttcatgtattggcaacttaatctccaatgaaacaatgttgagaggtgggacctttaagaggtgattatgtaatgaatggattactctgccctcatgaatggattaatgccattatcacaggaatggattcctgatacaatgatgagtttggtcccctttcccttcctctctcatgctctcttgtccctccacttctgctgcaggatgacacagcaagaaggccctcaccagatgctgagcagatgccggcaccatgcctgtggacttcccagcctccagaactgtgagccaaataaatttctttatacatttcccagtctcaggtattctgttagcggcacaaaacagtaaataccttccatgaggcggcaggcaagtaggcccctggcccagatgaggaggcttccttttctcagtggggtagctctcaaatctcccatgcagggtgggggcgaattcctccagacaagcttcagggccttggccttgcctcagttaggggaaggggcctgattagaggtctttcagtgagaggtgatgagcggagccaggctggcccctgacccctgcctgtagccaggttgcctccctgcaccaggcaccttctcctccttagcagactcacctggggatccattctttaagccccaaaggagaaaagtcagggccctgaggaagaggggcaccaactgcctgattctgaagagtctgccctgatctgcctgagcctggggtctgactttgggaagtttgggcatcaggtccctgttatgagttgtggctggagggcttcagcctcctctagtctccttcagttggccccacctctggcaggccaggggctacagggaaggaagagcccatttaatcagctcctgccctggccaggtccctcatttggggtgttatatgccatatcttgtttaaacctcgcaaccccttgcaaggtagcgaatatcaagcccatgttacagatgaagaaactgaggctcagagaggtcgtccttagtcaaggctcagtactagtaagtggcaggtttgggacttgaaataaagcgtggttctgttccctacacttttttttcctgtaagatgcttggcctgggcacaggtgggtggtagtcccttgacccctgcaggactgtgacatgggaagggacactctattctgagtccatgggggcagggatcatcaggttgaatgaatgcgtgactgaattaaagcacttgctgtgctgtttaattttaagagagaaggggccttactgagaatccactggcctgacagtctgaaggccttggcgtggagcccaccctccatggccttgctgtgtgatcttggtcagggcctgcctctttatgggtctaatgtacaggaaggagaggtggaaactatttgctagatgggccttcaggctgggcatcctagccttaagaaactaggctgcagacccaatgacctcaggctgtaggcagtgggaaatctggcaagaggcatgatacggctcctgcgtgtgtgttgtgtgggaggggcagacgagaggccctcagggttcggcgccccagaaagccaggaggcctcaggcccctggtggacacagaagcaacccagctgtataaccctagcccctctcccacccatacacaaattattgggttccaggggctttttggtctttgaatgaagcttttggagaagtctgtccttctctatccatgactaggctggggccctgcacaggatctgtggactggtggctctctggcctctcctggttatgggactggcccagcagcttcaggctgcttggtctggccaggttcagcctgcactgcccagagccacaaggtggcacccaagcaccacatgtgtccaaggccacccgggctcatgtcttgctggagggactgtgcctgaggaaggtgcagcctgtgcctgtgggtaggtagtttgaggtacctcatcctcagacatcactggtgcacccctctgccccagccataggactgtctgtggggccatgctggtgtcagggcctgaggcaggagacctgggatctggttctggccctgtgtggtcctggcaagttgcttcctgtctttgagcctcagagtgctcttctgaaaaatgggcataaaaatagcactgacatcttcgttcattgattcactcagtcagcacatgtttattgagcacttactaggctagggtgtaacatacagctccaaacaagtgaagcctcgcagcggtgttcagaggattagatgaagtgatacctataatttatttagcacaattactaacatacattatggactctatataaatattagctaaaaccttatgtctaatttttgtggttagtcctatgattatccctattttagggaagaggaaacagggaaaggtattgcccatggccacacagccaggaagtagcagagctgggattgaatctgggctgcctgactctaaaccccactctgctggttcccacatttaatctggggctgtgtgtggctcctctgagctccctttaatattctccagaggaccttggatcaacttgggtcacttcctcaggccttccccatctgaatgctcagcctcctcctcccccagagtccccgactcctgcaggtttggtcctggcagggactggctgggaaagtcagtggtcatcaagaagccaacagtgattcagggccgtaagaaggtcccaggcccagctccctcctgctaccacctggggttgagacccgctaggaaatggaggccagagccacctggccctggtcccatcccgaatgtccatcacacttagctgggaccactgagctcaggcctttcctaagggtctgtgagggggagaggggggagcattcgaggatttctctctcagagagaatgtgggcccccatctgattgaaagggagttgtgggacgcatcttgaagttgagtttccatagcaagctctctgtttctgctgaggcacaactgggctcctcagagcctcaacgatgctctcaacctgtcagggggtgccctagccgtatcctccactcctcccagcccatcctgggacactaggtgggacttagtcacagccggggccgaaaactatatgcctgaagacgggctcaggtgggtgaatggcctctgtgaactgcagtgggactgggggcccatcatcatattgacaaccagacatctctgcaccttcaggcatgcagtgctcggccctggctgtgactaagtcccacctagtgtcccaggatgggctgggaggagtagaggatagggctagggcaccccctgccaggttgagagcatcgtcgaggctctggggagcccagttgtgcctcagaccgccaggctgcagctgagggttgtaccagccccagcggtgacagcagcgtatccatggtgtgcctgggcaacctggagaaagctctgtgccccccaagggctggaaaagtttcggccaccgtggagaaagctgtgggccgcatgggaaaaagttgtagctcctcaaacttttctcactgtgagcttatggctctctgtccctgaggtcagctgagtgatttgccaacaattaggccataatgagctggacctcagtggcctgggagtctcccaggggtacttgggctcaacaggacacctggggcccagttacagcagcctgagctgatgccaggtccagctgcgacctgagccccaaggatatgggcctgccccatgtgaccactttgcttgcatggccaaacttttaatgagtgaaaatggctacttctcttacttgctggtagcccaggcatgccacctgggtcctgcctgctcactccttaaagaaccagcaatttctaaaatatgacttgctgcagtttaagtgatcagctaatcaacaggttatgtggggtctagacgctgccccactgtgtgaccctggactgagccccaggcctctctcagtcttagttttcagcgataataatcacaggcttggcgtgaggcccagatgaaaataacacaaactgtaaagtgatggttcctttcaaatgatcattattgtccttaattattgcatcatattagcctggccaggaccttgactctgaccctcactcctggtgaatgagagccagctctgacctgggtgctcagaggcagctgcgtggcccctcctggctctgctggccactggcctgccctctgctccaggctgggctggcctagcaaccacactgtttataggtctctcttggctcaactatcttttttttctcctgctctgttaacaccctaggcctgcagacgggcaccactgagagtgttaagagccctgatattatcaagtccagtccttactgcatagatgggaaacaaaagcccagggagaagcagggtctgagctggaactccttcctttcccggggcttagtcacaagaaggcttcatgcgtatgcagtactttagtgtcgtctggccttctcggcagccctgtgagggtaggtaggctggcacccatctgtccactcacttactaagcttgcagattctaaagccagactgactgggtggacattctgtctccactatttactaggcatgtctctgtgcctcagtttcctcaaatgggaaaacactagtaattacatcatatgattgttgtgttaaatgagttagaatctatatgaaatgtatagaacatggcctagtgcaggctctcaataattaatatcagctatccttctggttatgattcagtcattcagtcagcaaacatttattgagctcctactgtgtgctgagcttggtagtgctagaacctggggatatagcagtgaagaagactgatttttggaactcagttttgtgaaggtgagggagacagacacatgaagccataatttcaagaccaaggatttggcaggctgaggtggggtataagcaggggaatacagtggaggggccttgatcccttctagggggagggaggcacagtcagggaagtcttctcagaggaggcagaagcagaagtaggcattgggccctgtgcaaagtgctttatatccaggatgttagtctatcctcacacaaacctgtgaggtagatgaggcgctctttttactgaagaggaaactgatggttatttgtctaaggtcactcagccagtaaattattaggtcagggtccaatccagggttgtctaaccccaaattttgtcccttttctttttctatgagggtgtttgtggcggtggttatgatggacagatgggggaggaggtcctacgcagacaggaggcactcacaggaaattctggctttgctgatgagggtgcaaacctggggtttcctttccgtggctggtacagaggcaggataccacagtgggtaccaggacaggccctgcccctggctgcctgggttccaactcacttactattagtgtggtctagagcaagtcacttaactgctctgtgcctcagtttcctcctctgtgcaatggggataatgataatggcaagcacttgcgtagcacttgtaagggctttcttttaaggattttacatctattactcataggatcctcagattctgtgtcttttttcctcagatggccataatacctgggtagctttaaggaataaattagttaatatacggaaggcacttagaacagtgcttggcacataggcaacgctcagtaaatgttagttattcttattcagcaccacagagtggagtcccaggaggctacagacagaattcctaaaaataatgaagatgattatgataacactagcaacaataaaacatgccctcatagttttacagcactttttaggatacaaagactcccacagctattgtttcatctgagactgaggagacaagtgtgtctaaaagtgtacacagaaaacactttttaaaaagacattcttattagcatcctgtgggatgtcttttttaaaagtgttctctgttcaaataagtttggaaaacactgaatcaaaccaagttaaacacttttcttcttggagagactcaagctcactaaacgttgtcagaccccacaaaagcagagggaagtacaacatgcagtgtttccccaaattattgggccatgaaatcctttgttctgaggagttgtgactcctggaagacactttctcaaacactggggtaggccgggcgtggtggctcatgcctataattctagtgctttgggaggctaagtgggaggatcacttgagaccaggactttgagaccagcctgggcaacatagagagaccctgtctgtaccaaaaataattaaaaaagagaaaacactggggtaaagagctttggctttgtcactggctgtgtgccttcaggtcaagtcatatgaatctaggcctcagttttcccatatgtaaaatgggaataaacgtacactcatgatggggccatcagtgttgtaagaactaaatgaggtcactggagtaacgtacacagcctaattcctggcaaatggacaataaacgttagattattatcgccgtgacacccctatgaaataacaccattattttccccacccagatggggagctcagtaggtagctccggggcccttcactttagtgtgtcagtggagcaccctcacatcccaggctgggcgccagagggcgactggctctttcccttccctccccattcccttttaaagatggatgaggcctcggttcaatgagggccccaggcaggggacggccacacccaggtttttggaggggccggggagggcgcgttcggggatggcactgggagtgggcagggctgacgcccctttgcccccagcccggtcttcctctacggcgacttcgccgcggggcagtgcggggaggcgctcagtgtagagctcgtgggggcctccgctgacagcggggcagggactgggagaagggcggcggcggagcaggtcgcgggctggtgcggggcctgggggcactgccgagcctacactgcggcggccgcggcggcggcggcagcgcgacaagttgccatggcccggctgccgcagctgccctcccaagggtctcgttagctctgcttggccggccaccgccgactcggccctagggaccccggcgacctagcaaacagccgatccgccgggcgctgacgaggctcgggggaagagggcggcagtccagatggcgcgcaagtgagtgccaggccgcgaggatttgccgccgggacccagggcgcactagctaggtgcgccgcccacccgcggcctcacgggggcgcccgagtccactgaatgagcccggcggggccgacagcagcagtcgagcgcgggtgcgccactctgaccgccgctcgctggtctcattgccggggcctgagcgggggctggggtgggtgccaacgaggaaagcacagttgatctgcaagttagtgggcggggagccagtagggagggactgcggagccgcgctggtcctgattcttcctcactcagctattttaatagcaatgaaatcttgaaggagtgctctgaggctgatagagctgtaggaaaaggtcttgggcgttcagatttttggatgcttcgtatttttcaactttattatctggcaacagtctttaaaactcaatgaccaattccagttctagccttaaacccaattaatccttaactatgaaagcagcatcctaaagtctactttcacttgttagcggcatctgtggaagtagccgagggtctcaggcagtgcagtagctctctgaatagcctctctttcctgagaaagggagcctcagctgctgtgcccaccaggcctggtgggagcgtgcgctcactgcgtaatagagcagggctgtgcttgtgaggtccctttggcccaaactgtgcaggatctgctgcctgcctttcctttttgttgtatcgttattgctttggcccagaaagctctgatgctacctgcctgcaaatagctcatctttactcaatacccgggtcctcacccctttatactgtgccccctctggactgtgatgcctgatgcttgtgtggtcagattgcattgacaagagatctcttccttgtcttataagggcactaatcccatcaggagggtcccaccctcttgacctagtctaaacctaattacctcccaaaggccccacctcctaatacctcattgggggttctggcttcagcataggaatttgggggggcacagaagactttaatccacaagagatgggttcctgacagtagtaaccactccccatccacccctgagtgctggtagtcagggtcacgttagactggagtggtatagagaagacttcaccactctgtagaaaaaggcaagaagtcttaactgaaagggaagtttctggtccctttttcaaaattacctccctggctctttaaaatgctgtattttataaaatgttttcgatttccctttcagatgtgcaggccaacctcaaggtgtgggttgcttagattacaaaggaacttgaattctttcatgtttttgtttaaagtatcactatcatcatctaaagccaagattggctgctttgaggaccttttctgaaccgtgtactaggataataactctgaaggagactgttcttggaaaaggctgatgttgggaccttgctagccattttggaattagggaatgaggtgtattggcatgagcagcagcacttttgtggctgtcaggcagagattttcttttcttttttcctttataagtcacccaacccaaattgttatcaggcagatatttttataggggtagtgggaggcagttcccaagtcccctgtccctctctgcacctagtctaccctctaagattgcaaccatcatagcatcttcttacacattacaatgcagtaaacttgggcacattgagcaccagtcatggccgctgtgttcctgaaggtacagaagtggcactggggccaggctgctgtctggaaaatgttagccactttggtggtactgcccttccgacaccgcctcctcacctcccccacccctacacacaaaaaacaagacaagtagagcaaacaaaccacttctccaggtagacagacctgcaggtctgctcatggtgaccctctctttagcctgcattgtttccaaggccttcagctggcctattgtttgctaagggcccacaccttggcaggagctgaaaagagaggatttccttttgctcaggggaggagggtctgtcctgggtttgcagagataggcttcttgtctatgctgctgaagaaaacaaactagacaggagtcagatgtgggctctaccttcttgctcagtctctaattcactgtggccttgggcagatcagttctccatccttattagtatcttgggtggaatactccttaaggaatctttcaagtattgagtgcccccatgcccccaccaccttccacaaccaggcctaggtgaggcaggaaggaagaaaagaaagtctgggtgcagagtgtgtagtatgcctcacagtacagcctgcaggaaggccttggataagaaaggctgagtgatattccagggggtgggacagaacagagtgtggtttgggtgggaagatgacctggtgaacctcaggttctctcaaggctttacagaggtgggagcagggccatgggtaggctggctacagtatccctgctgaaagggaatacttgttggtacaaactcagctcttggggcaaggatcatatgaacttgcggtcatgaaagtgtaagtagggtagaaatatgaggaagggagaggcacttggtcatggccaaggctggagtgtcattaatgtgtgggggttgaggaagcaggtcacaggattgttggatggctcattctacagtcttgtgccctgggagcccctcatgtgggagacaggtggtggatgtcaggaagagctagaggtgggaagggtaggcttgatatttagactatgtgtcaagtagggcagggccagttactgaaataccgaaacactagttgtcatttggaaatggctgaggccccaggctccctgaggcccccagccaccttgtccttggaaccttgctggtgctcactggcccatacactgtctgcccagtgtattccctgggctctgaccccagtccctatgtgtcctcttgaccagggtatgcacctggacgtcagtgggaattcacttccccaggggaagtgctggaatccccatatacacttctggctcctgaggctgtgtctgctggatggtgcctccccagtgtcactgtcccgtggtggcttgtgggaaccctgcctgcactgtgaacggtatcggtcgttatgtatgctgacaatcacccctggtaaaggaaggggacagtagggtgaagaattctgttttgggtgcctggccgctttgcagcggggacagagggcaagacctggcaggcctgcagtcttcctcggctatcgtgaagagggttgtgagtgccaaatccatcccatagggagatcccagaggagactctggcaccccctctgccagagggcaggcccatgagtgcggccctgcagaccaacagtttcttaccctccttccttcgcgagacctggcacagctgcctgcctcactcctgggagccgagtcctactgggagctcgttcctgccaaggctgggatccagtccccctctcccctctgtgggcacttggcaggccgaggtccctgcttccctctgccagttcctgccaaagctaatctccctgcggcctgttcctggcagtggttgcacgtgggtatctctgctgggcaggcctgcttccatcactggcacggaccccatttcccaagaatcctttttgggtggcacaatcccaggcagaattctcccaggaggttcctgagtgcctcccttgctggttcagcacctgatcacgttcctggattccccctgaactcctccagtgtctgcaggatgcttttcagttcacaaagcactttcatattatatctcattagatgctcagcagcccctcaaacagcaagtggtgcccttgagcctgcagggccctggagtgggcagatttcctgaaccatctgctctgactctgcctttgggccagtggagaggcctttgtgagaccaaatcttcaggttctcggtggggcaggtggcagttcagtaggaggtggcctcgggcctcctcttctggggaaggtgtcagagaggggtcaggagactatgtagcctcttgtggccccagtcccctgatcaaaaaccaataggaaaagtctcttagaagagaaacagcttttgggttaatctgtaggggcagtgagaaagggttggggaggttggggcccagctgggccacgtggattcgatcttggcttagagtgggcacaggaagctatgtgatgaaggggagcccctagggaggaatctgggtacaggggatggggctggaatcagctacctggtccgtaagttgtgttgttaaatttggagaaaaactgttttccaaaaatggaggtaaattgaagtttgtaagagctggtgaataagccatgcctccttggtggtttggagcaagacgttttccacgcaggccatttcatcaagactcagtggtaatttgggattgcctcagctctcccagctcggctgcctgttgctgtcagtgggtctggggggcctcagggctgcagaggcttggtggtgtgggagtccttcacctgagggctgacgtgccttttgggggtctggagcatacttccaggagacaacctctcttcctcctgtcacctctgctcctccctcagcctccctgtgttcctttaagcagggggcatgggaagaatttcttctgaagcaactgatgttctaaatttgagagaggggaataccatcatgtggcctgaagttagcagcccagaggctgagggctgtggctctggcaggtgctggtgtccagggtgcaaggaagactccaatgtccagaggactctcatgaaggtgactgggagcagactgtggtggaggtgacagctcagggaggaagatgggattgtcaggactcagttctttgctggaagagacttctcttccatggggtggtgagtccaagtgagaccttggttcctcttcctgggtagaatcctcccttccattggaattatcctaaaggtccaccccactgactcctagcggcctctttcctggtaaggaagtctgattggcttttggcttggctaacctgagtcacttcttccagagctgtcctcatgctgcagccactgctgtcccacagcagctgtgggtcatccttcagctacagatcctcccattttccttgtccccccatcagtgtgcgtgcacacttctgtgtatgcaggtttggggtaggcttggtctgcaactgcgggggccatgcgcagttgagttcagtctggtcatgccacagaattatttacactgaaaccctaaaaccctctagcgaaaggttagatctttaagtcagacttgtttggcaggtcagtgagatgacagggaggtttaagacctgaattgggggatggggcacaaaggagtcgtggctgtttctggatctaaggcctctgtagggaggtgagatccagactgggtagaggctggtgattcttctggagccaactctgtgccaggccctattgtggctgtggaggagcatagttaaaactctgtgctttccaggacttgaagtctgtgcactgcccttactacgataaacaaaggaatgaaagttcctctcccaggtccatgattcagagggctcttaggggtatgtgtgtaggaggcggtttgctgctcatgcagacatttggagaaactctggttccatctcgtcacccccacaccagcatccaggaagacatatgggcagactggtgcgggccagcaggtgtggggatgcttctttgctgtgagcttctgccaggtgttagagagggaaatcgaagtgtccagctgccccagagctgggagtccttcagatttaccagaactttctgattacaaagacttcctgcttattgttttgattcttaggattataatcttacttttgctttccatgctcacatccccagtctgaatctggggctgcttctcaccactgccagcctcaaggcagagaaggcaggctcctctcccatttgtgttccctctaaatggttgcataggtactcgcttgcagaaccattactaccaatagtggaaaaatgagatggggagggcaatatacttttattcttattttatttgagacaggttctcattatgtcacccacacccatgctggagtgcattggtgtgatcacagctcctgggctcaggtgttcctcttgcctcaggcaatttttaaaaaatttcacacttgattggccaagaacctcccctccgacccccacaacaacctacccagcatttactcctcagtctgaggacacgtccctcacatcagcccctctgctgtcttgaaaggctcacctcctggaagctggctcctccctgattcagggcccagcacagcgtcggaaaaatggagcagtgctgcccactgtgttcgaaggcctccctcctctgttttattctgggccccttgggcagggcttacatcagagccagtcctccttggctgattcaaagggacaaactcctgggtcagtcctgaggacaaggaatagtgagtgggtgagggaggggctggcaacaactggagtgtgtctggccacaagctagactgtggctgcagctgatggccatcatcaagctggcgccaaagctgccctcctgcccaggtttccagagattctctagctagttctcttctctgttctttggaagatttactgccttattccaccgctttagtggttatcctacaatttcctacatttttctttgacttaaataagtaaaatctttactccttttcctgagccattcaaggaacttgggttattttaactttactttcctcctgccttacatgattttcttttaaaaacttaattttatttataattccagagttatagaaaatttgtaacagttggtgtacagtatttccatatatcccctctcaagttccatatatattaatatttaactacatataccttataattctttccctccccaacatcatttttttctgaactatttgatactgatctacatatatgtgctgtgttacccctaaatatatccttgtgtatttcccaagatataaaaatattctcataaaattatcacacagttatcaaaagcaggtaattaagaagacacaatgctatactctaatttacaaaccttattcaaatttcaccgaatgtcttagttatgtctttatagccagagaaggaaaaaaatacatatttttcttgtctaggatttagtctagaatcatgttacatttagtcatttctagtcttctttaagccgatttctcttggtctttctttcacttttcttttttgaggggtacaggacaattattttgtagaatgaccttatttgggtttgtctgatgtttcctcatgattagattccagttatgtatttctggcagaaatgccacagaagtgatattgtgtccttctcagtgcattgttatcaggaggcacatgatgttggtttttgtcccactgctggagataataactttggtcacttggataaggtggtgtctgccaggctttgtctgccattgcaaagttaatattttcatttggtaattaagctttgggaaatactttgagatgatataaatattctgtttctcatcagactttacccactaaattttagcatcctttgatgattagtgtttgaggtataatggttgtaaaatggtgaattttctgcttccattatttctcatacatttattagttgttactctactgtaaggaagagtttacctccctccctcccaatccatccatccatccatccatccatccatccatccatccatccacccgcccatccatccatctacctacccacccatcttccattcagtcagtctggattcatagatatttattttatttaattagttatgctttgttactagcattggtgattttgatgatcaaaattatcccagattagtcctgtgagagctcctccaagttgattcttgtgtctttttgacacactgctattactttttgagcacttccttactttctgttactacaagatattccaggctcatcttgtactttcccggctcaaactctgtaatctggtatttttctaagaaaccctgattccttttagcagagaattgtgtataaaaacaaaccaagacctggaataggtctgttcattgccagagtgttgttatttttaggccctgtcatacatatacacacatgtgtgtgtagtatatatattatgtaaatatgcacacacacacatgcaaatccattcatctatctacctacctacttacctacctatctttcttaaaaaccatgagttcatactgatatgaccagttccaatccaacactctagagttcattttaaccttctctctttccatatatgtaatttccttctccaaccgtgaaaaacctggtttcagttacccacagtatatttacttatttgcttaatcctagaatacacagaatgtagtttcagaattgttaactcatgctggtgtgggaaacaaatctattaaacagagttcaatatttgctactgtctttttgccctagcctgagaatacagaggcaaagtactgcttcaaaacttctgttatcaccccctacccgtactgtgttttgtcattcacttaacctacagttcggtacacttgcttccatatgtattcaatgctaatgtttcctccttttatccttgttgattgtatttactgaaaaactgagtacatgaaacattaacatggttgtaaaagtcagaacagatctgtacaaaaacatgaactcagagaagtgtcactgccctccatcttctctaccttgctcccaccatcttattcttttcacccatcaggctaaaaaaagacatcagagaaaaatatatcctaatatgttgagtttattcgggagtaagcaaaaggattataatctgggaagcacagctgtagcaagccataggtacaggtacatcaagccaaaggtaaagggaaatttttactggcaaggagaagctatgtaagctgcttggagacagagttcattggttctggaggctcaaagctagaattagcatcagttcattggtggagatgccactgctaggcatcggcctagcatcttatcagaattgctacagtcctaaagaatgtatagtgataaacctggtcatagaaatatgtgcatgcatgtaaaatgtaaaatgcatgtaaaatgtagatcatgaaaagcatgagatgtataaaagatgaaggaatttctcgtggagttattttagaaagtccttgaaatagtccttatctcagatgtgcaagcatgagctgtgctcctttgtgtgttctggctccagtttgctcgggtctgacaaaagtgacttattttgctatctgcaactttagtcactccatttccacccactcctgtatggaaccaatctcattagtttctgggtttcctttcctaagtttctttttgtatagttgtgcagacaaatatatattttcttattcccctttctttcttgcacaaaacgtggcataccataaacactttctcacactttgctttttaaatttaacagcatatcttgggagccattctatatcagtttatagatgtcatcctcattcatttttatagctgcagactattccattcgatgatgtaccatagttcattcaaccattttcctatgtaaagtcattttggttgtttctaatatttttcaattataaacaatgctacaatgaaaatccttaaacatatgtatttttgtatatatttgaatatgtattaccaggataaattataaaaagggggaaaagcatgtgccattttgtttgatatcatcaaattctcccccattaaggttgtactaatttccattcccatcagaaatgcttgagcatctactttcttcaagccttgccaacagaacgtgttagtgtatgtttacatttttgccaatctgctaggtgagagataatatctcagtgttattttaatttgcatttctcttattatagttgaggctgaatgttttttcacatgtttacgggacattttaattcttttttcagtcaatggtctgtttatgtctttgactatttgaccatttttatatcaggtttttgaaacttctatcgagtagaaaaagttatttatatattagcgatattacatatgtatctgtgttatatattaccgatcttttctctcagtgtttaatttattttgggatttttttttttttttctgcgacagagtcttgctctgttgcccaggctagagggtagtggtacaggctcggctcactgcaacctccccctcccaggttcaagcgattctcctgcctcagtcttctgagtagctgggattacaggtgcccgccaccacgcccggctaatttttgaatttttagtagagacggggtttcaccacgttggccaggctggtcttaaactcctgacttcaggtgatctgcctaccttggcctcccaatgtgctgggattacaggcgtgagccacagcacccggccaggacttttcttttttctttttttttttgaataaaataattttatttttgtataataaaataattttatttttgtataataaaataattttatttttatataatacaatttatcagtcttttattgttttggatgagttcacttccattaaatccagggaagtgaaattatatatgtgaccttaatatgagttttaataatctacttttcaatttttcagtattttaaatatttctttaatgttctggaaaaaatagccactagcaaatacagaaatacgtgtacacaggggcacacatttttccttttgtctctgtctccagtacgtctcagggcagcactgagcagaggcctatgggccatctcagtctttcattagagccagtagccaaaacatatctgtccaagagctatgacaacagcagcaaagcttgtggaagcctcagccaacttagtcctagagtttccaccaaactgaatggttccccatagtgaacactgttttactgagagaaaacagtcagcgcttcttggttatccacctccctaagagttataatagcgatagaaaaatatgagaaaacttcaacttcagtagatttagttctgacgcctccgctaaacttagtggttccccatgctctgcggacgcttatattcacagaatatcctcaccactttttgctagttgcctaccctctgtgacatatcgttgcctcccccttcgcatatcactgtccagtgtggcaatactctacacacagccacctccttcttttaaaggaggtggctttacctctgttaagggactatcatgctctttcagatctttttttaaatttttattttttaaccttttaaaaatttcaatagtttttggggaacaggtgatttttggttacatggataagttcttcagtgataattactgagatgcagccatcacctgagcagtgtacattgtacccaatgtgtagtcttttatccctcgtccccctcccaacttcccccttgtctccaccgtcccttttatcattcttacacttttgcgtccttgtagcttagctctcacttataaatgagaactacaatatttggttttccattcctgaatttcttcacttagaataatggtctccaattccatacaagttgctgcaaatgccattattttgttccttttaatggttgagtagtatttcactatatatatatatatatatctcacatatatatcacatatatatgtgtatataaatgtgatatatatatgtatacacacactacatttttaaaatccactttttggttgatgggcatttaggctggccccatatttttgcaattgcaaattgttttgctataaacatatgtgcaagtgtctttttcatataatgaactcttttcctctgggtagatactcaatagtgggattgctggatcaaatggtagttgtactgttagttctttgaggaatctccatactgttttccatactggttgtactagtttacattcccaccagcagtgtagaagtgttccctgttcactgtatccacactaacatctacggtttttttgatttttttattatggccattcttgcaggagtaagggggtatctcattgtggttttaatttgcagttccctgatgattagtgatgttgagcagttttcatatgtttgttggccatttgtacatcttcttttgagaattgtctattcatgtcctttgcccactttttgatgggattattttttttttcttgctgatttgtttgaattccttgtcgattctggatattagtcctttgtatgatgcatagtttgcaaatactttctcccgtcctgtgggttgtctgtttactctgctgattatttcttttgctgtgcagaagctttttagtttaattaggtcccatctatttttgtttttattgcacttgcttttgggttcttgttcatgaactctttgcctaagccaatgtctagaagagttttactgatgttatcttttataatttttatagttccaagtcttagatttaagtctctgatccatcttgagttgatttttgtataaggtgagagatgaggatccagtttctttcttctagatggtgtccttttcccactttatgtttttgtttactttgtcaaggatcagttggctttaagtatttgagtttatttctgcgttctctattctgttccattggtctacatgccaatttttataccagtgccatgctgttttggtaactatagctttatagtagaatttgaagttgggtaatatgcctgcagatttattctttttgcttagtcttgctttggctatgtggtgtctttttttgttccatattaattttaggattattttttctagttctgtgaagaatgatgatggtactttgatgggaattgcattgaatctgtagatcccttttggcagtatggtcattttcactatattgattccacccacccatgatcttgggatgtgtttccatttgtttgtgttgtcaatgatttctttcagcagtgttttgtagttttccttttagagatttttcacctccttggttaggtatattcccaagtattttattttttggacacccctcatttaattgtttgtagatggttcatacctaaaaagaaaaactacaagttgccaattatgttatactatcacagacttgaatttacctttaagcttctcaaagaaatgaaatctgttcagatggctaaattgcctttgtccagacatgccagccaacaaaagataaaaaacaaatacttgtcctgatggtgggtatgattttgggttggcccatgattttgaaatgctttaaaaaaaaaggacattttctgactgttacaggaatccttataaaatggatagcaaattaaggaaccctgagaagttttccattacctaaagaaatggccatgataaatgtagaatttagcaaaagtgcttcatgatattacccataatacaagagataaatctgccatgatttttattttattttttattttttgacttttattttaagttcaggggtatatgtataggtttgctacataggtcaactcatgccacaggggttgttgtacagattattttgtcacccaggtattaagcctggtatccattagttattttgtcttatcctcaccctcctcccaccctgcactttctggcgggcctcagtgtctgttgttcccctctctgtgtccatgtgttcttataatttagctcccatttacaagtgagaacatgtggtatttggttttctgttcctgtgttagtttgctaaggataatggcctccagctccatccgtgttcctgcaaaggacatgaccttgttcttttttatttgtcatgatattgaaccaacattgatgggggtaattttaggaggtttcatagacatttccaaaatatgtccaacctgacaatgacacaatcctggcaagattttaaggataggtcatggacaggaaccgaagtctcactgcccctttgaacgtctccaaatgtgctgagtgcattctgattattgttgtttattcttagggttagttgatgttttaccttactggagagtggtagctatagtggtaggaacaaatttgcttaattttgttgtatttctgacttggaaaatcccaacttattttgcagttaagaggaacacacatatcactggtactgttgttactgaaccctgcaatgctttactttttactcagaatctctactgacctttatcatccacaaaattcagggaaaagatagaactaaaattctaaaagtataattatcagagctctcaaaaccctcacactcctaaggcttgaggagtgctattggtgttgatggaagtaagaccaattttcaggacctacaggtggccacctttggaattcataacaggcttcctcactacttgcaatcctagattctacattatgagtacaagctgatatgattcattgctgaagggtactcacaataactccagctttatcaccaacaggtaaacgctgcatttctacaacagccacctgtgcaggccctgcatgctctgtaacctggggatttggtcttctgaaaagggcaccagagaaaaactgctcttaagcctctgttaactgacacagcagtagaactccaaggtgttgatccttggattcatgtttctcaacttcagagacacacatcactccttcctgaccactgggcatccatcccaccaggagctcctaatctgagagctgttagaaatcctccaaaagtgctgactgcagaagttggtagcttctgctcaagatgacagaacaagattaacttttgtattcttcagcaccttttttattttccattatcacactttgataccctctaaaacattaaaacaccttctagaatgcttatgtgatcaacttgatctttgtcttattaattttgacctctgtcatctccttctaccacttaagaaaaaaccaaaactcccttgtgcatctttttcaaaccacagctactgccctgaatttaactaattactgacaaaatctagtaagtatcacttcagacacttcagaaggaagtacaggccctttctagtacttaagtttgccttacaccacaaatcccaaccttcagtcctgtaaaaactggagcttgatgtcacatcaatggaatgcttctgacaatgtcatcacaatcctttcagcacaacctgggtgtcatgagtgagcactgacataggactatccttgctacagctaccactctgttctcttcagagacactctggcttgcttctcaaaaactgtttaactctactcaagaacagcccacaaaaaatcctgacccatagctgttgtgctaaaatgaactttctgtttccatacaatctgtgccccactaagatgctaccaaagcagacatcaggcttacactgcctgctgtaatataggaagtagatgtttccacatcaataaatattcctttcatacgctgctaatgtattcatgcagcccattagatagatgtactaaaacgaagttagccagttttaaatataattttgtatttatgtgctcttttaatttattcatattaaaacagacatgatcattatcttttaatatacattttacaacttgtatggttattttttgagaataagctgacagatttggattgatgggtaaaatgtaagcatatacgttaaagggtttaaaaaaatctgtaatgctaaactattatccagtgaggttttattggtctataatcccaacaacagcctacccattgtcagcttgctcacacccatgccagcactggaattagctagccttttcatcttcgctggagcgggaggtgatccagtagaaaaaaatggcaccattttttccctagttagaaattcttgggttactggtaaaggtgaactttccttctgttgttcggctggactctagacaggagctggtgtgaggcaatttaaaatgctgctttccagagaggcctggagagactgttctctgtgctgtagagggagctgttcatgagaagagggagcctgaaagggcgttgtcattgttgttctctcctgctaccccatgcctcacagaaaggtccacaggccaggaacagggaaaggggttcctgtgtttatgccacttgtagacggcacaatacaaacctggctgcagaaagagaaaaagagaaggttatcatcagacacagtgaataatgggaaataatttcagagaatcagaaaactgttaactagaaagtgaggctgaggaagtgacctacgagaaatggacaaggactcgatttacacagtaacgagagggacagagagagaaacccagagaacaggcagtggctggcacagaggcggcagggctgagaggaatggagtgagtgtctcccagacagtgagctctgagctgcactatccagagcacaggggaacgccagagcgaagagccccacctcctcaaggaggcagaggctttccacattttctctaaactctccttccctcccaaataaaatggccctgtctgtcccatggcctctgcctcaactacaaaaatatctgtccccctgggggtggggaaggagagatgtgtcaataccagggaatggctccagtgagggcaaggaggcctcgctgggcaggcgggggactaccagcatccatctgagcagccccactctcagcatccaggacgacacagaggaaacacaaaagcttatgtcccagaatcctggagggatgtgggcagga

SEQ ID NO: 70 - DNA, 1161 bp, Homo sapiens
acccgggaaaccggaagccgcctcccacttggttgctcgtacgcggctagtgggtcctcagtggatgtaggctgggcgccgcgatgttcgacgggacaccggcggagagcgacctcggggttaaggggtggggctgacgtcaggagccaagatggcggcggtggtcgccctctccttgaggcgccggttgccggccacaacccttggcggagcctgcctgcaggcctcccgaggagcccagacagctgcagccacagctccccgtatcaagaaatttgccatctatcgatgggacccagacaaggctggagacaaacctcatatgcagacttatgaagttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaatctcaggaaggcaagcagcagtatctgcagtccatagaagagcgtgagaaactggacgggctctacgagtgcattctctgtgcctgctgtagcaccagctgccccagctactggtggaacggagacaaatatctggggcctgcagttcttatgcaggcctatcgctggatgattgactccagagatgacttcacagaggagcgcctggccaagctgcaggacccattctctctataccgctgccacaccatcatgaactgcacaaggacctgtcctaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaattttaagaaataaatgttattctactttattaacaaaaaaaaaaaaaaaaaa

SEQ ID NO: 71 - DNA, 2592 bp, Homo sapiens
gcgtcacttccgtccagaccggaacccaagatggctgcgctgttgctgagacacgttggtcgtcattgcctccgagcccactttagccctcagctctgtatcagaaattggtctcttcccatggcgatgtccatctgccaccgtggcactggtattgctttgagtgcagatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttgactctccttgaaatctagagaaaccaagaaaatggctgttgggaaggaaccaatttcctcctcttccctcgggtctcaggcatttacatcctccctctccccgcaatctgacctttaccaggagggaaacagttctcctacatctcatcattggaaaagttttcagggaatcagatagaacttagccagagatttaaatatcacagaaaagcctcagagaaggaaggagaaaaagaaaagaagtgacgcatgtagagtgcttttgggttataggcaccaaaatcccattaaggactgattataagcttcatggtacagttcagcaaattatgattcattgaggggcacagaggaccagtgttggtgacagctaggggatgatgacctgaggttataggcttggggtgaatgaagcatagagtttttttttaaaaaagaagggattgttgaaaacctggcaaaaatgtataatttaatgagaaaacttgctgcttttaaaatccatataggccaggctttagcaggcatgctgttttgatagtttttgggaactctggaataagagacttatctcatctgtcacttcgagttgttggccagccagttaaagctgtgggtcgaagaggggaaatgttaactggctggtgtcaattggataggaagaccttagttaaggtggggacccgctgttttaacagtcttcattcagggtcccaaatagtatttggctttaagtaatgattggttttccctttttactagaggggccctgggaagtccttgtacctttcctccattttaaaccagctgttctctactttgtccttggaatgagggacaagtgatcatgacagaacactttgtcattgggactgggaaaggtttggcaagggcattaaatttaacagccagtgccaggaaaatataaaatggggtcaatgataaacagctgttagaggctggaaaatgggtagggcagttgaattttttggtggtttcgtaccatttgggtgattgaagcatggtagtgggtgggtggggggtgtgacagagcatcatgtttgttattctgccttaaatttctacttactgtctttttcttctctgtcttccaatcactttaatatcttcaattttcaaactatatttgtacttgggcttagatagaaagtcttacacaagcatagtatcttctactttggttttccctaccttttcttccccaccttctccaaacacacatatacatactctactcaattctatttctgattttgtagttgttagttgtccatgctcaggataaaaaatgagtgggtagggttgagggactggttctttgaggttctgccctttttccatgattcagaccaactttctcttggtcatttctggagtataactgactcaattcttgtaaaaatgtgttccacccaaaccactgtatgttcttttccctactttattttctcctaccttccttctcctaattgtgttacaagaggcagccatagcaagaatggaaaatccagatcagtaaaagattcaacaaaaaaaa

SEQ ID NO: 72 - DNA, 1525 bp, Homo sapiens
cctgttttctttcgtcgtcgtgggtgggaattgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggctggagtgcaatggtgcgatcttggctcggcacgatctcggctcagcacgatctcagcttactgcaacctccgcctttcgggttcaagcgattctcctgcctcagcctcccaagtagctggcattacaggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccctgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaatgttatataataaaagtgtcttctatgcttttatatatta

SEQ ID NO: 73 - DNA, 1433 bp, Homo sapiens
agagccggttcctggaaagagctggttccctggcaggctggagggcaggagctggggccacgctggtctgggatagttgggcagggagacggagtctcgatctgtcacccaggctggagtgcagtggcacaaccttggctcactgcaacctccgcctcccaggttcaagtgattctcctgcctcagccttctgagtagctggaattacaagctgtctacctggtctccagaatggacggccctgtggcagagcatgccaagcaggagccctttcacgtggtcacacctctgttggagagctgggcgctgtcccaggtggcgggcatgcctgtcttcctcaagtgtgagaatgtgcagcccagcggctccttcaagattcggggcattgggcatttctgccaggagatggccaagaagggatgcagacacctggtgtgctcctcagggggtaatgcgggcatcgctgctgcctatgctgctaggaagctgggcattcctgccaccatcgtgctccccgagagcacctccctgcaggtggtgcagaggctgcagggggagggggccgaggttcagctgactggaaaggtctgggacgaggccaatctgagggcgcaagagttggccaagagggacggctgggagaatgtccccccgtttgaccaccccctaatatggaaaggccacgccagcctggtgcaggagctgaaagcagtgctgaggaccccaccaggtgccctggtgctggcagttgggggtgggggtctcctggccggggtggtggctggcctgctggaggtgggctggcagcatgtacccatcattgccatggagacccatggggcacactgcttcaatgcggccatcacagccggcaagctggtcacacttccagacatcaccagtgtggccaagagcctgggtgccaagacggtggccgctcgggccctggagtgcatgcaggtgtgcaagattcactctgaagtggtggaggacaccgaggctgtgagcgctgtgcagcagctcctggatgatgagcgtatgctggtggagcctgcctgtggggcagccttagcagccatctactcaggcctcctgcggaggctccaggccgagggctgcctgcccccttccctgacttcagttgtggtaatcgtgtgtggaggcaacaacatcaacagccgagagctgcaggctttgaaaacccacctgggccaggtctgaggggtcccatcctggccccaaagacccctgagaggcccatggacagtcctgtgtctggatgaggaggactcagtgctggcagatggcagtggaagctgccctgtgcaactgtgctggctgcctcctgaaggaagccctcctggactgcttcttttggctctccgacaactccggccaataaacactttctgaattgaaaaaaaaaaaaaaaa

SEQ ID NO: 74 - DNA, 832 bp, Homo sapiens
aagaagatgaacaagcgccagggtgtgttgctgagagtgagtggtcccagtggagggaagatctttggagatgtggatgggggcccaggaattgagacagcacagtgttgatggaccacccacctggctctgcagatcaccccaacaactgcaggattgtgaagaggaagattgaggcaggtaccaaactctattaccaggttttaaacttcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctggtgaaatagttgtttttaaagttgaaggacgagacattccaatagttcacagagtaatcaaagttcatgaaaaagataatggagacatcaaatttctgactaaaggagataataatgaagttgatgatagaggcttgtacaaagaaggccagaactggctggaaaagaaggacgtggtgggaagagcaagagggtttttaccatatgttggtatggtcaccataataatgaatgactatccaaaattcaagtatgctcttttggctgtaatgggtgcatatgtgttactaaaacgtgaatcctaaaatgagaagcagttcctgggaccagattgaaatgaattctgttgaaaaagagaaaaactaatatatttgagatgttccattttctgtataaaagggaacagtgtggagatgtttttgtcttgtccaaataaaagattcaccagtaaagatgg

SEQ ID NO: 75 - DNA, 3656 bp, Homo sapiens
agcgatccgaggcccggccccggccccgccccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggtaaaaaaaaaaaaaaaaaaaaa

SEQ ID NO: 76 - DNA, 583 bp, Homo sapiens
gccagctgccggtctttcgggggctccgtaactttctatccgtccgcgtcagcgccttgccaccctcatctccaatatgcctggtccgacccccagtggcactaacgtgggatcctcagggcgctctcccagcaaagcagtggccgcccgggcggcgggatccactgtccggcagaggaaaaatgccagctgtgggacaaggagtgcaggccgcacaacctcggcaggcaccggggggatgtggcgattctacacagaagattcacctgggctcaaagttggccctgttccagtattggttatgagtcttctgttcatcgcttctgtatttatgttgcacatttggggcaagtacactcgttcgtagattcagttacatccatctgtcatctgaagaaggaggaaaaaacccaacatttcttggaccaaaagtatagtgactatctgttcatgagagaaattttctgtaagcttgctgttttacaggggatttatcaataattgattttgaggaatcagtttttttctatggctaataaactttttaattcacttatactgaaaaaaaaaaaaaaaaaaaaaa

SEQ ID NO: 77 - DNA, 480 bp, Homo sapiens
ggcagaaacccggattccggttccggtgggcctccatcagcaagctccagtgctacgtgtccctggcattttaggtgtcggttgggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtgggtttttttttttcctttcaagatgttttctatttctaaattaaagtaatttcaaagtaaatgaataaaaaaaaaaaaaaaaaaa

SEQ ID NO: 78 - DNA, 69315 bp, Homo sapiens
ttatgcctgtctttactgccatctctgaatataaattgtgaagatttcatggacatttatcacttccctaataatactcttacaatttcttatgtctgtctttactttaatctcttaatcacgttatcttcgtaagctgagaatgtctgtaacctcaggaccattattgtacaaattgattgtaaaacatgtgtttgaacaatatgaaatcagtgcaccctgaaaaagaacagaataacagtgattttcagggaacaagggaagataaccataaggtctgactgcctgcggggttgggcagaatagagccatatttttcttcttgcagagagcctataaacggacatgtgagtaggagagatatcgctgaattcttttcccagcaaggaatattaataattgataccctgggaaagaatgcattcctgggaggaggtctataaacggctgctctgggagtgtctatcttatgtggttgagataaggactgaaatacaccctggtctcctgcagtaccctcaggcttactaggagtgggaaattccagcatggtaaattctagtcagactggttttctgctctcgaaccctgtttcctgttaagatgtttatcaagacaatacgtgcacagtgggacatagaccctcatcagtaattctaattttgccttcgccttgtgatctttattgccctttgaagcatgtgatccttgtgacttactccctgttcatacaccccctccccttttaaaatccctaataaaaacttgctggttttgcagctcggggtcatcatcatggtcctaccaatatgtgatgtcacccccaagaggcccagctgtaaaattcctctctttgtactctttctctttttcagaccagccaacacttagggaaaataaaaaagaacctatgttgaaatattgggggctggttcccccgatagaaggcaggggcacttctaacagcatccaatctagagcaaacccaacttccttagtctctgacaaatcacccaatcaaagcccaaattctaagataggttctttctaataccctcctacggagataccttatggtgtattttttttccacactgcaatgagtaataaagccaatgtgctcaactacaggaatgttcctgtatatttgtggaaggaaggaaggacctgtgaaaataatgttcctaatgcaacattcactaattaaatacattgctatctactcaagggttaactgaatttaatgggagctctaagctgtttatctctaccttataaagttcacttcatcgagttcttatttaaatttagttataatccagtctctccctggaactagcagttaacaaatttatgaaaatattggacccaaggatgcctgtccagttatttagggtaaaaacatatcctggcctttcctttatctggtatgagtcaacactgctcagagaacacacatgtccagagcaaatgtcacctcacgatgaaacttggtaaacagcctgaggctccctcccccctttcatcttctatcagcttcaaacattaggtagatcaaacatactcctccacaatctatgatctgcaatccaaacttaatgctcttaattataatcatggaaactggcatgaacacccaaaacttattaatttgatcactttgatcacctgccatatgctgtcctgaagttaggagggataagatgaggtataagtccattgttcatttactccaagagctcagaatataaataagaagatgccaggttctatctcactatataatgcaagagtttatattttcatttatgcatgaaaactttaatttacctcatctataggaaagaaagtacattcttttctaagccctgaagggaaaaatattctgcttcttgcttctccctaatcctgccctggcaaataccttaatacaaatgctgacagtcttgcctattaccaattcaaatggaacgcaaagaaaagcacaggaaaggatatatcccactagagttggtgacaattgccccattctcaggaaaagtctctggaggttgtctcaccatccttaagtgaaaagcaagttggatttatgtcctcaacacgttcaggttctcagcatttgttaattgcttgattcatttcaatggcatgaggttacatcagtgtcatctgcattaaaaggtgtttattacctacctctgttgagtgctatgctgtgctgcaatgcagagcaaacaggttttctgcaacttggaaatctctgacaatgacccagaatgctgatatggacagatggaataaagacagctgagcaaatattgaagcagtctaagaattaataaataatattaacattttgtacaagtacataaccttaactgggaatgctggcaggtaaccttgaggagtgtatgcacagactggataggccatggagaattcacaaccttttttctaattaatctcatgtaatatagcaggctgataaaataaatctgactttcccacagcatattctgaaccactttggagacttggaacttccccaggaagtcaggtcctatgagaattctcagagcacgtcagctactcattgctggctaaaggcaaaagctctagcagctctaagcccttttcgcattaagggtataaaactaatttccctccttcgcctcaaccaagcaatcaataagaaacaatactatatgtaaaacatcctacaatgtagaaagtgcttttatcctgtgtctccattttgaatctcacaacagacaggcaagacatatctatcaaccaataaataattaactagtgctagtggtggcaagtccagcactatatacctatacacagaatcacatgatcatctccagcctcagcatgtttacaatctgtttataaggcaagattgtgagtgttcaatagattcttagagaaatgaagattaatgaggacagatctggttggagaagtgtgatccaagacgaaatgtgaatgaaattgggaaggatgccagagttatggctaagtgaaagaagcaagggcagttggagaaagggtagaggaacccttaggaagacatgattgtgttaatgtgaaatctggaaagtaaaacggaagtggctatttggtccatgcagcagcacccagaacaacccttaaatataagacgtactcagtaaagacaaaactgaaaaaagaagttggggcttaactaagcagcaaactttccccagttttaatcaaacagataatcactggctcttctgtagaaggcagaagtttcttccctggtacttccccaacagagtagaactgtcagcacagttcctattttgtgagtagaataagttctaattttttttattctgtgaaaagtgtagccattgaaaattttcaataggcatatgaaagcagtgtttaaggaaaattaatatggccatgatatgtgattcaggttaaagggagaatgatgtcagtgagtatggctggaactcaggtgcatcatccaggtgagagaaaatgaaagccattaggggagttttcagtgaggaagagaacagaggtacataataaaataaaacaatttaaaagttacatagtttaaactgatagaacttgattatcaataagatgaaaaagaaaggaaaatataccagattttactctatgatttataatcagaggaactcagagggaacattgttagtgacagaaatggtgatgtagctgaaaagacaagtttttggaggagataattctttccttcatctcctccgatgtgaatgagaaacagtggttggttttttaccatcttcctgaaaataaaaggctgtatctcaaaaaacaaaaaacaaaaaacaaaaaaaaaaaggaaggaagacaaatgcccagaagtgttaagacacatggccagcagagacttttccaaagtccttcacttggctggactaggttctaggccttagagctgactgtgggtggatgacagggaaagcagaatgacacggtttgagaaaagaaagggcaggcacaccaagtcactgctctgctactcagttggaacatgcctggatttcgtgcttattacatagagtatttccgtgcctgcgatgcaatcactatcacctctacctccacacacgtgaacctggtctcctgactttagttaggaaagaagagaacaatgcaactcacaagaggagaaggatgaggacaagtgtttaaaataatttttcaaagctgttggcacattttctttatgattattgtctggtgaacctagtgaaaataaatactgtattgagataatctgtgccgagcggatttatttccttttgttttgtcggagaaaggaggacaggtactgagttgcaccctggtttccgtacttcacggtactgttttatctaagttttaaaaaacacctcaaattcaactagctgtggcatttttctcagtgctcttatcactatgcccaatttaaattttttaaataaaacaggaaaagatgctaaacacattacaagttcttaaaattattccttaatatttattttgggtcaatttaaaaaggcttgtgaatccatagccttgagttaatatttagcccaggtgttagttaaattctaacttcaacagtcacccgcacttgtaaatcttgccctacgatggactacgtttcccaagagcaccccccgagttaatcacatgaagcgcattctgggaattgtagtctcggatgagcctctttctcccagtcttggactcacgcgctgattccggttgaacccaggggctaccaattagctggggccatgtccgtgagtcgtggtccaaccgagaaagctggtgtgggagcttcgtacaatgattggccaatgaatgacccccggggcggagcaatgggggtgggcggggagaccatggtgattggaccagaagcccgcgacggcgggcggggattggctgcgcgctgggtcagggaagcctgggaaggggcggaggaaggagactagagcaggaagagcagcggcgaggcggcggtggtggctgagtccgtggtggcagaggcgaaggcgacagctctaggggttggcaccggccccgagaggaggatgcgggtccggatagggctgacgctgctgctgtgtgcggtgctgctgagcttggcctcggcgtcctcgggtcagtatccgccccctcgggctgaaggcccagagcctccgccccccagcctctacagccggcggggccgtggggactccaggctcgggaccccgttctccctgggcacatctcgcactgggctgtcactcgctctttggctttgcttggcctgcgccaaaggggctatttaggaaggtggagtggggtggaaaaagaaggggcggtcaccctgcccacacctctctcccacgtaacaaactttgcgcgactcttctcacgaacgcggaattgactccaaaggaatgaatcctgatacaggagcccgagtggagcttcctcgaccctggggtagaggaagggtctggtctagaactctgggcttgggaattgtaagttaaataattgacaaacctggagctgtcactttggggcagaggaggatccatccagaccaggatgttgacagtagtttgcttaacacctgagatggtccctggtctgtctgtttaaaaacgaagacttttgatctcatcgtagccactttttacttttttgaaaccttcctgagaaagcggtgacctgtcacagtgtttctgagttgccccatgtttgttgacagtcattttatgatgtttgggaaaatcttggttcttataagatgcgttttatatagatacagaaatttgtgtgcttttgaattgattttccagttagctaatgtttattctggttctgcttttttcccccttttttaatgttttaatctgcctacatttgaaaatttccattttgagagtgttcatgaaaacttcgtgtttctaagtgttgataaataaaaattagtacagtaaaactttggaattttaatcagtttcagttaacaggacaggtgttctgtggcttgacgttttggggggacaacacggagtataaatgtcagctttttctttttttaataaatgtcagcttttttttaacagaaaatttcccagatggttatctgaatccccaaattacctgtcctagttgtaaatcaatgccataacgtcattctgcttctaaaataagaggcttaaacctaaattctatccatgatgtggtttgagataccatttcaaaagcaccaaccctatgctaattactttactgccaacatcattctttcaggtccactcccctccctccagtagtagtgatggtttgagttaatgaccagatctttagactatacttaactctcgaagcacttttagcagttatttaatatttgatcaaaaagcatgaaatgaagctgttgagcttaatgagtagagtacctgctggaccatggacctcctgcatcagaattcctcttatgggtttgttaaacattgggttttaggtctggaacagctcaggtatacatagattaacaatctccatgagggattcttcacactaaagagaactacagtaatgaaagagcacggtgtgtatccctctgaatttaattggcagagtttaaagaaaattaaagcataggaattgtgctgtctgtctttgactgcattttatatacttagagctccatgccagtggaaaagatatttgaagatcaacagttggggctttcaggatgttgtaataaaagacttaacactgatatattaaatccttgggttgtattgatgtaggtagaggactgtattcaagaaatgtctgctctgatttccatcatagttaaagctgtgccacaacatttcaatggtaaaggcagaagccttagccagaactaaaacaatgtagatgtgcatgctaaaaggtaataaaggcagtgctgtgctcacatgaagttcatatatcataaaacacctgtgcgggcccagctcatacctgtaatcccagcactttgggaggctgaagtggaaggatcacttgagcccaggagttcaagaccaacctgggcaacatggcgaaaccccatctctacgtaactccaggtgtgatggtgcacacgtgtagttccagctactcgggaggctgaggtggcaggatggagtgagccccaggaggttgaggctgcactgagctgtgattatgccactgcactccagcctggacaatagagcgagaccctgtctcaaaaaaaaagaaaaaaaaacaaccctgtgttaaataaagttgtgtaaattaagctatggattttcaattgtgattttcattcacagggtttcggcctcaaagtttaaagttttactccagtattaaaatcaagtttttggttataattttgtgtttgaacattagtggttacccagggcaggtcgcatctctccaggtggagtatggtcagccaacaaagagaatcttgattctattgctgttgatagctgttagctagtatcatgttttagaagcatgtaaaaatatgatatagtcacatgctacataatgacattttggtcaacaatgaaccccatgtaagatggtggccctgtaagaatataatggagctgaaaaattcctgtcacctagtgacattgtagccattggaacatggtagcacactttttaaaaaataaatttagtgtagtttaagtgtacagtgtttacaatagtgtatagtaacatcctaggcttcacattcactcactcactcacccacagcaactcttaatcctgcaagttccatttatggtaagtgccctagacaggtatatgttttgtaatcttttacaccatattttcactgtagcttttctatgtttagctatgtttatgtacacaaatacttactgttatgttacagttgcctacagtagtctgtatagtcacatgctgtacagatttgtagcttaggaacaacaggctacactatgtagcccaggtatgtagaaggctatcccatttaggtttaagtatacaaaaaggaaatcgcccagtgatacacttttcagaacatatcctcgtcattgacacatggctaatattagaaacattttctcttttctattaataaatttaaaggaggacactaaaaagatatttcttcattttctcaggataatagtgaaaaggttataatttttctcacaaatgcatgctttcttatttttggcagaagaggcaaatggcttaacctttttttttctttgtgccaagcagtgttagtcattttagttaggtccactgccaggtatttcaggtaataattataaattcagagagtagttttcagacagcagaggatgtttaatttcactgttttggtcgttccttaaaatattgtgagtcagcgggacagaggtgttaccccttttgacagattgagaaacagaggctgagcaagcttttgttactgaaccatgtgtcagaattaacatgtgatgaagccaggttccagacctagctctccaggtctcagaattgaagaaatttagaatcgagagtatcttaggatctgtaccaatttagagctaaagcagagaacaggatatctggtctgttttcaccaaactatttagactttctgtgtttaaaggttatcagtctgtttaatttacgtgatgaatggaaaaatgattttgtagtgatcacttttccctgaaagcatatctctggtactttgcagttttgttagctaatacaataaaaataaaaactggtccttttcaaaggaaggtgtacagttaataaaataatatgaaccatttggatgtgatgctgatgagcgagaagcgcataacttaatccttttgcatttttttcttgttgcttgatatctgtgttctgatgaaaacattactgtttgctttttatttatgcataacttcagtctctttaatccttacctgaatactacttatcagaagttcctaggttataaacaactctttaaaaagtgttgtgtgaatgtttatatcagtttgaaaaagaaaatagcttatgctttgagactaccatctggagtaggctttcccagtttagtaactgagaattatcttattcaccagtaatattagcatatagtccaggttgcgaagagagagggagagaaagagaagcatgatgcaattcacatgaaataactctgatgttacaaatcatgtttcttggagtttgaaaacacgttttgctactctaatgcctaacagcttgtgctgtgtgaaatgtacatgtctttaagtgtatttacagatgtgtccatatgattcacctgttagctacctatgtaacctgttgtggtgaggtactaaatgtagcaatgtagtgatagtgatttagagttccagctaatctaaagtttcattcagtatttgggggtatttcatatatgtttaaacatttaatatctgttttgatatattaactagttgaagtttgtgattaattacatatacttacagtacaactttgatatattatagagatgggttttttaaatttatctaaagatttgctgagaatggaatttgaaccacatgttagaaattgggctttgggtaatacttgtgaagaagttagcatgaaggacaattgttaattaactgacatcattgcctaatgttatgggcgctgtgggactaatatgtggcatacccttctctccacctgccagaagtaaaacatactttgaaggtaatctaaaagtaggtgaatatgaatagtagctgtaatttaaattttctttgacttgacagcactttcatatatggcaaaacctcactaatggactagtttcctcaaatattcgaaagaaatattgtgaggtagtgtcttgtattttgtgcataattgagttggttatacttcttagtcttaactcagtactttgataacaaactctaacacaggttttttgttatattttagagttgcaaattacaaatgatatttaggatatagccatatgaagtaaagtataaatgacaactatagtagcaaattttctagtaaaaaatgacatggtcttacagggttttgtctactggttaatttctcatacagcttatggagcaggtaaaactgaaactcactcctgaataaaatcaggtaattttaagagcaagagggaaacttaaagatgatctgacagattcgctgttttaaactggcaaggaatacaaaaatcaagcatttccatctgaacattgagttgttgcatgtgtttatgtaagagcaggaagaagagtaacaagcagccagaaaagtaatagtcagaaaacatggaaaaagtaacagaaggaaaattaatgtaatcagacaacaccaaagcaggctgtgtgaatgtgtaagcaaggtgtaaccggtggctgtttttcattgtttaatgtaagttattgatttcttactacatagctctcaattgagtgaatatatgataggaccatgctgctttttacctgcatctggttatctctgagtagagtagaacacaaatcctaaatataattgttttgcaactctgctatcaaataataattcttagtttccatccttactatagtagtaaacaatacaaatactaatgagcactaaaatgggctactctaactcaagatcctgagcagacaaacagaataggtggaagcccggagtatgaaattagagatttatttttatgaacttagtaactcattctcagaaatagactaaatagacccacaagaattggatggaatgtgaagaaatacctgtttttgttggtggaggctgttggtcttcctacctttgtaacagatggagctaatgtcttttctggagaaagagagaaactaaacccccaacccattttttttttcctttcacttgatcttttctgaacaattgctgaatatagctaactttaaaataattctatgtttatttatccaatgtttgattattatttgctatacttttcacatgttttcttttaataataactaatttcccaacaagaaagattactaaattgtcttaaaatttctttgcagatgaagaaggcagccaggatgaatccttagattccaaggtatgtactaaaatgtgtattggccagtatttgctgcctgatttaaaaggatgaattatgtatcttagaaaggatatgaggtctgcaacttttgagtaacagttgaattaaaaaggacagaaaaagacagatggtattagtattagttctagtttttctggaggaagaaaaaattactgacctacaagagggaatagtaaatatttcatttcaacttgaatgtgctctgtgtgtgtgtgtgtgtgtgtgtgtgtgtgtgtgtaagtttgaagatttaacctgtgtcatttgtttccactttccagttctcaaaaataaatccagtgagctaatgcacttattggttgattgagctctcccttccaagtactaaccaagcccaaccctgcagtcagttatgagctctgatctttagatttgagggaatgtagataaaagcaggaagtagaagtataaggtatgttgggggcatgtggaggaaaaccgaacccagactttgggaattaaggaaggcttctgggggaagtaacatctaagttgaaattcaaaaaggctacaagttaggtgatgaaggaaggcacgtgatggacacatgccaaagcctatagagatgagtgagtgtggcacttcaaggagctgaaggagatgtgatatctggattagtaaaaataacggtcaaatagggttggggaaagtcttggcattgttgataactaaaaatactttatattctcagactactttgacatcagatgagtcagtaaaggaccatactactgcaggcagagtagttgctggtcaaatatttcttgattcagaagaatctgaattagaatcctctattcaagaagaggaagacagcctcaagagccaagagggggaaagtgtcacagaagatatcagctttctagagtctccaaatccagaaaacaaggactatgaagagccaaagaaagtacggaaaccaggtagtctggacattttccttgctttttgatttatttaggggacaactgaaaattttaagctaatgaataaagaggctgaagaagactggcttcactgattattacccacaaataatatatggagtgtagtttggagagaatttctagattttaatataccaaagttattcacttaacagatttgacccaagttacataagctgaattcaatagatgagattgcatttatctttttattaatatcctgacgtttctttttggaatcaagtatgtaaatacatttctcactgagaaatttaaaaaaataatatgtcagggtagcatacaaaacagaaactcaggaagaactgtctaacatgccactatggttattttcaggattgtggtaggattattactacaataaccttgtcgatcatcctaggtaatttgatttaggtgtttatccctcagctgacgcttgtgtgtacttccatcctattctaactttcacaatcttgaaacctctacttttcaatttaaaacttgacctttttcacaatagtcttctaaatattaatccttttaaaaattattaatgtatgcattctaccatgtcttgttgcccttctgtcatttattatttcaatgatcactgccttatctgtttattattccattactaaccactctcaggaactgatccaaatttgaactttttaaaaaaatagaatttttttttactacaaatataccattctcatgaatagaaaactatttttaaaaaattaaaagtacctgaatcccatcaactagaaataacagctgctcacatcatggagaatattctctcaggatttttttaggtgtatcagtagttttaagaaaagtaaattgggtcaaaatgtgtattctatgttgcagcctgcattttgcacttaacagtttaccatgaatgtttttccatgtcatttagcttattttcaatttgatagttaatggctataaaaaattttatttgtaaatatatggtaccataaaccaaaacgtttatgttttgctgggagatcattttagatgtatctttgtgcctatctgtgaaaatttccttagaattcttaaagtaaatttgctgaattggatgtaaaagtttaaaagacagtagatacacattgttaaattgttcttcagaaaagtgattctgtttacttcctctgaaaatacctctttccctgtacctcacccaagtgtgtattaccattttaaaatttttactaaatataatttaattcattcttcattttttaattagggattttttttttttttttttagtttttatatttttagagacatggtctcactctgtcactcaggctggagtgcagtggcacgatcatagttcactgcagccttgaactcaggtgatctccctctttggcctcccaaagtgctgggattacaggcatgagacactacatcaagcctgggaaatttttaaacatgcataaaagtagagggtaaaatgacaccccttaccaaccctcactcagcttcaataaacatcaacattctgctggtcttttcatctttactaccctacacacatttgccctttttttctttcctagaatattttaaggcaaattccgcatgtgcttttacatctctgtgtctctctctagtaagaatgttcttttcagcaaaatcacagaattagccattactcctttattacctaatacccagactgtttaatttttctagttgcttcaagtgtctgtttacaatttatttgtttgaattcatttctaagctaagacctaggtttctcttaatctgttgctgttctccctcttttgttgttgttctttttttttgagacagagtcttgcactgttgcccagtctggagtgcaatggcatgaccttggcttactgcagcctccacctcccgggttcaagagattctcctgccccagcctcctgagtagctgggataccaggcgcgtaccaccatgcctggctaattttcttctatttttagtagagttggggtttcaccatgttggccaggctggtctcgaactcctgaccttaagtgatctgcccaccttggcctcccacagtgctgggattacaggcgtgagccaccgcacccagcccctcctttgtttttaagtgtcattttatttgctaaagaaatatgcagtatcctttgtgctatacagtttcccacgttttggatcttgctggtcatgaacttgtaatgtcattgagcttgttccattatctgctgtttattctataaactgggagttagttctagagacatgggtagatttggttctgtctttttattgagagtatttcataggtaggtggtggtgtgtactttctgttgctttacattgagagacatgtagtgtctgatttttccacttttactgatgttaagattaattagcgaggtcaggtggtatcaccctgatctcaccattctaaagttcctcattaatcttttgcctaggggttttggcaaccatttatgtttgttgcctggatcttttaattattaggggttgcaaaatggtgactttctaattctaccattcctcctgcatttgttacctgggattcttttataaagaattttctctcatcaagtctttgattaccctgaaatatagtctcatccagagaaagctagataaattcttatttcctttgcactgttgtgaaatgaaaatttggtgcccaagcaatctctgaaagagactaatgagtatgtttttgtttgtttgtatttgttttgttttgctttgtatttgagcattgtaaggatatagtaaaaaccaaaccaaggtgtgtttttctttctctttctcactgagttaacacttctgacaccagatatgttgtgggtatttccccacataccaagtaagcaatcagttctgcagaggattctccatcagagaccagcaggatgtctgctgatttaattcaattctgacactacctggagatagcattagatctcacaagtttagggctcagtctcacaagaccagtccccgctacttgagatgccaatcataagccccgggttgtctgtgcttctgacagactggctataaatcagggttcccacaacccccttcttgggttcaattaatttgctagcacttaggactctgggaagcatgataaatgggtaaatgtaaatataaatttacatttattataaaggatattacaaaggatagagacgaaaagccagatggaagagaggtgtagggcaaggtatgggagaaggactgcagagcttccatgcccactctgatctgatcacgccacccaccttccaggaatctccatgtgctcagctttccagaaactcccagaactcagctattttgggtttttatggaagctttgttatgcaggcataattgattaaatcattgcgcgttgatttattggctcaacttttagctcctctgcccttctgaggttgggggatgggactgtaaattctaaccctctaatctaatctaatggttggtttccctggcaaccaagtcctatcccaaggctctctaggaacctccagccaccaattttctcattatcatacagaagacattcttatcactcaagagatttcagggattttaagagctatgtttctggaaacggatgaagatcaaatatttttttcacaatatcacaagcatcattatgaattcatggattcttacatacatgtcagccctctgtatccatggattcaaccaaatatttgaaaatatttggaaaaaatgggtggttgcaactgtactgaacatgtccacactttttgttcttgtcattattccctgaacaatgtagcgtaactatttacatagcatttccattatattaggtattagaagtagtctagggatgatgtaaaacaggaggattgcgtaggttatatgcaagtactacgtcattttatctaaacaacttgagcactcatggattttggtaccaccaggccaggtcctggacccagtcctccagtgatactgagggacagtcatgtgtcacttaacaatggggatgcattctgagaaatgcatcactagttaattttatcgttgtgcaaatatagagtgtacttacacgaacctagctagtgtagcctatacctcggctatatgttatagcctattgctactaggctacaaacttctacagcttgttattgtattgaataccgtactcagctgtaacacagtggtaattatgtgtatatctaaacctatctaaacatagaaaaagcacataaaaatatggtataaaagatttttaaatggtacgcttgtctagggcacttcccatgaatggaacttgcaggactggaagttgctgtgggtgagtctgtgagtgagtggttagtgctgagtgaatgtgaaggcctgggacattgctgtacaccactgtaaacttttataaacaagtacacttaggctgcactaaatttattttcaaaattttttttcaatagtaaattaaccttcgtttatggtaacttttttagtttataaacttttatgttttagcttttcaactattttgtagtaacacttagcttaaaatacaaacacattgtagagctatacaaaaatattttctttatatattatccttattctataagctgttttctatttttaaatttttttttaactttttaaacgtttttgttaaaaactaagacaaacatacacattagcctacgcctacacagggtcaggatcatcaatatcactgtcttccacctccacatcttgtcccattggaaggtcttcagggccattaacaggcatggaactgtcatctcctatgataacgatgcctgtacttcctgaaggacacacctaatgctgttttacagttaacttttttttttaataagtaggagtacatgctaaagtaaggatgaaaagtatagtaaatatgtagaccagtaacatagttgtttgttatcactatcaagtgttatgtaccgtacgtaattgtattactatacttttatacaactggaagtgcagtaggtttattcacactagtttcactacaaaaacatgagtaatggattgtgctacagtgttgtaatgactaggacatcactaggtgataggaatttgtcagcgatataatcttatgggaccaccatggtatacacagtctgtcattggccaagaagttatgatgtgtcacatgatcatatttttgttcattgcaatcattcttttttgttgattgctcagaattttccttttttggccattggtaatcattcctttgtctttttgactagatcctggtgatctttcgtaactttttttttccaggcagaacaaggatgtcctaaacttattttgtacatttcttgacccagaaatgaaagtcagctatttctccaaggaacccagattgcttttggtgggttagataatataagcaccagtgatctgcattgctaaattttcattacttataggcctttttggtgcattgggttaggaaatgtatctttcataccgataacttctagttcaaattaaatattacaggcaagataacaaaaatcagattgacaaattgaacttacaagaatcagagatcctaacctagtatcaagcttggcaaatattttcaaagataaaattatcataagacgtgagcggggtgtagagaagtctgtgactgccagagctgctctcgggtcgtttctttcctcaattagactgtgctccagcccagagttcaacactcaaggcctctaagtaatgcctgtagagtgtcaattccacgaaagaaagctgtttccgacatgagacatcactggtttcttctttgataattacatagtgtatgtgatattttctagagagtcatgcctacatacatcccaggtttttgtataatgagcaatgtagacagatcaagttcatcctgctgaagcatttcataagcaaggactcttccaatagtaaataccttcagtgtgtttgccagaggtctctctttaccatatttctaaggtgatttgatgatgcttggagagaggtatctgctcactctgttttgggccagtgagaagaaagaacagactacaggtctgctgcgagccctttccaccttatcagagtttttgcttcttttgtgttatctcctttcactggtgctgaaaatcttagtacctaatgacattaatgttattttgttttatcataataaatatgcatatatagtttcaaaataacagtggcccttaccactaactgtgggaccacagaatgcagcccaagattcctttatggtccttcttattcttggtatatattttgctagggacttgtaataatacagtgttttaaaatcactaataattctctggttatatcaacaactttataaacatttagattaatttgtaccagttttcacttttcaataatgatttagatttgtttttaatttattcttaatatatgaaaatgcttaagtacttatgcatatatatgacataaattgcatatatatggctctgtgtacagttccagctacactagaactgggttatgtgacagttactttgaaacttttgccctttgtcagcctctcaatcatgttgctaccatattaatctttctcaaactcaaatttgaccccataactcccctgtttacaggcctccattacttccctgtttgcctgagagatgaagtatgcagtccttagcatgattcacagagccttcagtgtaccccttccctaagcagcctttttcagcaatacaaaacccttttctgttctccaaacacaacataacagtttatgcccctgggcctttgtacagattctcctcactgtttaggatgccttcctcattcctttgcccaaatccactgtcacaaatttctgttcattcttaaaaataaatgtaggttttctcctttctgaagtggttcctgaaccaaagtgtttactatatgtaagagcttcctatctggccttcttccttttgctctttcccccactatcagttccctaacagcagccagactgagactacttcctgctcagaaacctcctttggcttccggtcctactcaaagtaaaatccaaacttcttctatttacaaggcctgacatcaggcccttcctgtctctttaactaactcttctgccactcccctttaggtgactcccaccaaacttgccctcttgctatttcttgaatatttcacacttattcccagttgtgttggggaaccccaagaccacaccctcaggtgcagtaatttggtaggaagtgttcctagtaaatctatgctgactcaaaggactcagtgtagagttgtgttcacagctataatttgtcatagtggaagactagaaggcaaaatcagcaaaggaaaagtatggaatgaagtgtaggggaaaccagatgtaagctttcaagggtcctctcccggaggagtcacacggagtgcttaaatccagcagcaacaagttaagataacacatgtgaaatgttttccacccaggtagcttattagagaactagagtttttattgggggctggttaagttggcagtctcttcctggcatgtaccaaacttgcagaaggaaagcaggtgttcaacattgtacagtttgggtgagccactcttatctgtaggatggtgagaactctccagaaatctaaatttccagatgctaaccaagggccaaccttggaagccagccttctcaaagagagaagtttatgtctgtttttttaactcttctctgcacagtctactccctaggtcattggccaaggcatctttatagcagagttaccaataagacccagatagtagtgagaccagcctgcaatattgattttaggtatgccttttaggaggcctggacttagccagttaaaacaattcccatttatcataatggtctatcttagaaaaacaataggcttcctccctaagttttaacctttctaatctttttacctttttttttttttttttttttagacgaagtctcgctcttgtcccccaggttggagtgcagtggcatgatctctgctcactgcaaccttcgcctcctgggttcaagcgattctcctgcctcagtctcccaagcagctgggattacaggcacctgccaccacacccagctaatttttatatttttagtagagatggggtttcaccaggttggccaggctggtctcgaactcctgacctcaggtgatccacccacctcggcctcccaaagtgctgggattacaggagtgagccaccgcacccggcctaccttttttaaaacacattttacctattatttgtttttgtacgtggtcttaagtttctgtattaactttttttttttttaatcagctgcagcacaactgtggcctagtaagtggaagctgacctaaaagctttccagggctgagtcagtctcatgagagtcagagtacaagaagttccgtcccaagccgggcgcagtggctcatgcctgtaatcccagcattttgggaggccaaggcaggtggatcacttgaggccaggagttcaagaccagcctggccaatattgcaaaaccccatctctggtaagaatataaaaaattagctaggtatggtggcatgagaatcgcttgagcctgggagacagaggctgcagtgagccaagatcatgccacagcactccagcctaggtgacagagtgagactgtctcaaaaaaaaagaagaagaagttcagtcccagagggtacacatggtaaccctggaagcaaaccatcaattacagatactctgtttccaaaactcaaaagagttcaaattccagtcctctcactggcagcaaaaagcaaggaagttgtgtcccactaaacatttttttgcagcttcccctgatcaggattattcctctggtatttacaaaattacaggtgtttaacattttattttaatttttacaatacatctagatgcaatagccacaaaatataaagctattttaaaaatattcttctttttcttttttctccctactgcagtttactcagcctcctagcagtaaattcagtgtttgcactgttaacattacagctgccagggaagatcctggaatgcagtggaggaagggaggtgggggaggatattgtagcaagagcagcagccaggctgaaaaaaaactgctggattgttacctcccccagtttttttgtttgttttctggtttatctaaaattttgttccagaccagatttaactttttaaagagagcagttcaaacttgtaacgtttttggtttggcccatccttgggaatttgggggtcctttctcttcccatctagaagagagaacaaaaactacaggcctcacctgcaatacactgccttttccctcattttagccagcaggactaaaagcagtcaggggcatccagcaagccagctttcctggagctggatcttttactttcagattctatggctctcaacaaacagcagctcagctactgcttcatactgtggatgactccatgaccactcaggccccagagattcatcatattctgccctttagccttcctcttcttaacgctttcaccatatatcagtgagtcagggtcattctagcaaatcccacttctaatgcatctgtgtcagggaacccctaaaccatccccaggtttaatgatttggtagggggatttgacatatagttgccttcacagctatgatttattacagcaaaaggggacaaagcaaaatcagcacaggtgcaaggtacatgggggggaagtctggaggaaacaaggtagaagcttccaagggtcctctccctcagaactgatgcaggatcacttaattaccccagcggcaaattgtaacaacgcatgtgaaatgttgtctaccagggaggcttgttagagacccagtgcctggagtttttattgaaaactagtttgtaatcaccctctgctagcatgtaccaaaactgtagaatcccagaagaaaaatgggtagtattgcgtgtaaaccacatgtttgtacggtttgggctccgtacacttttataagttagaatggtggcgtgtccggaatttgttccttctaatgcccagacttcagggttgattccctccttaagcaggggacaacaaatgggtaacttgttccccatattcatgtagataatagctccagctttggctaatatatcgctccctaataagggtcctgggacttccaggcataacaaaggcatgtgaaaagagcaaagtctcccaattacaactgaggaggtgggagaaatacctggttacaggctgtcccaggattcctcggttggtaacggtccttgaggacagttgtctgggacaggaggttaacactgagaaggccacagtgtccaggaggaagtcaatttcctggccctcaatggttaaacgtacccggggctcggtgagggtgatgacgtgagctggcgcttggcctgggcaccctcagtcctgttgttggatcatctggttgggggcttctggtccagagaacctttgtcctctggggcagtgcaccttccagtgattgcctcggcatagtggacatgggcgagggggcagcttgtttctcactggacaattttttaaagtgtccttgcaaaccacactgataacaagccccaccaggtgattggcctcctctattttctgtcctctttgaaccaccaaggtttgtttgtctggagggccatgactaaggctgcagcctttctctgatctcacttttcctttttggcctgttcctcttggtccctattatagaacaccaaggttgccaggtttattaatgcctccagattttgttcggggcccagggctcacttttggagctttcttctgatatctgcggctgattgggtaataaacttaccctttagaatcaattgaccctcaagtgagtcaggtgacaggggaatatgttctcttaaggcctcttgaggaaggcagaaggattttcttcctttccctgagttatggtggacatcattgaataattcatgggctttttcctaattttccttagtccttctagaacacaggtcagcagatgtttatgactccagtccccatgatctgagtctagatcccagtggggatccatactggggacggcttgctgactggtagggaatttgtccctttcttcagctgtcagtctgtcatttacttgactaagataccaggtgtctccaaactctcaggctgcagctaaagctgcattcttttcattaaaggccagggtttgatctaacaataacataacatctctccaagtgagatcgaaggtttgccctagaccctgtaggacatctgtatacctatcaggatcatctgaaagcttccccaggtctgccttgatctgctttaaatcagagagggaggaggggacatgtacccaggttgggccaaattcccctcccctacagcttgaaggggacataaccaatagcctgtgggggtttgtggtcctttggagatttctttgcttgtttccttctgggcaggggagattagaggaggcttatcattaataggaaggggagctatagggaggctaggatatggaggtaagctaagaggtcctcctgtgggatgtaaattgtaagctttgcatagttgtggattctccttcaatgaaaagaaagcttggacataaggtatttcactccatttgccttccctcttacagaaaaggtcaagctgcaagatagtattgtaattgatacttccctcaggtgaccatttttccccatcagagagaatattggggccaggccatagtgcagaaaaaaatgagctgcctctttttcagggtttatgggtcaaattggtcccaatggcttaggatgcatttcaagggtgagcctattgatgcctgtttcccatctgaaagacagaaccgcccgcggttttggtttgtttctctccctgcccaagaacccacaagggtccctggaccctccggatcagaatagttgcgctcactgacaaagcagcagaaacactagttttcctcctagaccacaaagaggaccaaggaagattggatttagtggcccttaccaacgcattctcaaaatcctgcactcttgtctgtcctcctagaccccaaagaggactgagaaaaatcggatttagtgacccttaacaacgcattcttgaaaagctgttagagtcctaagcattctcctgttagtagtgggattttacccatgtcctataaagatgttatgccctgaaaatgaagtggagggccataccctaagggaggggagggatctccagagttggaagagtgatgccttttgtcctcacttgaataggaaggatatcatttctgaggctccccatatcctagcttcaggaatagcttttgttaggcctgctaccctgaggagggatcctaaaattacagataagttagtcccccgccccgatggggctttgggcaaaaattgtgtctttctggttagtgagcccaggtgcctaaagaagggaatagagtcctggagtatatactagaaatcattctcataggagaaactagaaaagcaccagagacagggagttgttttagaagcaggactagcctcagagaagagaggcgagaggaagtttgtctgacaagcattaggacccaggaagcaagggtcaggatagataggatagatgggcgagtctcacttgggcgacgtgacttcgagagttccgctcatggccacagggtcaacaaacttgtcgggaccccggagctgaatggctttcctctctgtccacccttggctcagccgagaagtacagggaaagcggaagctggttccaggcaaaccaacgctcccaattccgaagagttgggggtggttagagagctctttcccagaaagcctgacatccgtgtctttagtccggcggccgcgctagtcgcttttaactggctgacaggtgccagtatttagcccccgaattctaaggaaaagtaggacagaatagcaaacgaaaggggtctgatggtactcactgcttgctgattgtcccttcgtgggtgccaaaatgtgtccagaatttattccttctggtgggttcttggtctcgctgacttcaagaatgaagccacggactctcgcggtgagtgttacagttcttaaggtggcgcgtctggagttgtttgttcctcctgtgggttcgtggtctcactgacttcaggagtgaagccgcagaccttcgcagtgagtgttagagctcataaaggtagtgcggacccaaagagtgagcagcaacaagatttattgtgaagagcgaaagaacaaagctttcacagtgtggaaggggacccgagggggttgccactgctggctcaggtggccagcttttattcccttatttggccctgcccatgtcctgctaattggtccattttacggagcgctgattggtccattttacagagagctgattggtgcgtttacaaacctttagctagacacagagcactgattggtgcgttcttacagagtgctgattggtgcatgtacaaactttcagctagacacagagtgctgattggtgtgtttacaatcctttagctagacagaaaagttctccaagtccccacctgacccagaagcccagctggcttcacctctcagtgggaacccttccaaaatctaagtttgtagatagcagccgagggccacatgataagcggtctttcaaaagataactagtcaggcttgctgtgttaactgttttctgcatatcatctcaataaacatttgttgatcatgaatgaataattaaaacgccatcataaggagaatgattacattgtggtattccctattatagaatacccatagccattttaaaaggaacaggttttgttgtaaataaaaaaatccatcagacaatggcagaaccagaagtttatttggctcatgtaactagaactcacagataggcagttcaggacttgtgccatcagagactccagctctccctttcttcctgttcagctcctcagtagactggcttcatcctcatgtttgttccatgtggtcaaatctgatagtggctgcaccttcagggcctgggtcctcaggaagaagtgttgcctgcatcagaagagcagaagcattttcagaagacactaggagaattctgaaactatttctcctggggaagtggttcagaatcagtaatgaggcagtctgccctgtctgccacctacaagaatgtcaatgatatgttaagcaaaaaaatgtcctattgaaaagtagttcagttagtatgatcctgtattagtcacagttctccagagaaacagaaccaaaggccatttgcttggagaatttcttcctcatagggttcagtcttcattctgctcagtccttcaactgattgggtgaggtctgtccacatcatggaggataatctgctttactcaaagtccaccaatttaaataatttcatccaaaaatcaccttcatagaaacttccagaacaatgatatactcaatatctgggcactatggcccagccaggttgacacacaaaattaaaccatcacaaatcctttatgtgaaaagaagccatttgtaaaaataagtttgcaaatgaaaaaggtccagaacttcttttttcagtaactgtcattacctcttgacagaaataacttgaagtgataggtaaagataactgtcatttttctttaattttgtatactttcttactgtttgtctctgcagtaaacacatccttatagccttaaaaaagaaaaatagagtaattggcatcttgatctatttcaaatggcacaaaaggaactgagtttaaactgactacatcttgcttaaaattgggttctgaagcaagtttgttgagcaacagaatggcatttctacttcattgttgcttaaatggggatggcagggaaggaacgacctttaacctagcaatcatattaaacagaagatagaagaataggcagttgcctgcaacaggtcctgactttcatgaaaaggctttttttgttattgtttctttggtttgatttggttttacaagcaaattatttgtgcaaggaaactcctttaggagaccatccttgtagatcccagccacaccacagctttgaaaactcacgtgtctttaaagccgttgtttagagaaacccactgttcttaaacagcagctttcctgagcaagttttactctggatggtttttgacagtgcctgtcacctgattaatatgaagtttgccactttattctggtcacatgggccagtgattgtgctgctttctctttgtattttaaaatgattagttgcttctcacagaaagagctgagctttgtatgaaccctgatcttaacgttttgttcattctgcatatgaatacatcttctgaaaaatacattttaatctgtaaagtggtggctttcttcgtatagcgtgtgtttatttacaaagatagtttctagaccttatttagcagttttcaacttttggtgaaagcagtctgtagcaaattacataccattggtattttccccaaaatattactatagcatattcccagacaacagtaaaatattgcctgtatcatttggcctatatcacttactttaagtcaggtactttgtttcctttaaaccatatgtactggtgctttgttcatagtccttgggagattttttttggtgacaatcgtttgcttggttgagcttttatgttggtgtttactaaaattgatgaacactatgacagttgtcttgaggttggtagctttttaacattaaataattgtttctcagctatctttgactacaggtatatttgattcatatgctacttagtactctatgtttggaagtaccagattgtttcagagagacagcctaatagataattttcttatttaaatatcacctatgtaaactgtaaaagttcttaaaatgagaaatttgcaaagctaaattatgtttatctgtatagatcaagaaattaacttttagttttctgttttgattttacaatttaaagtgagaaaaagatgtgcttatattcccctagcctttaattgtctatatatatatatatagagagagagagagagagagagagagagagagagagagagagatcagcattctagctatgtttaccttttttgtcttggattctttccttcaatgttcaagcatactgtaatatcttatctgttaaaaacaaaaatcttgtatcccttagtccccctccagctaccatcccactcctctactcccctttatagcataattctttgaaatcgttctctataatcactgatttccctttctctcttcctgttctgtaatccagctccagcaaggcttgagcctcctccagactgctaaatctactcttctccactagtcacattctaattgctgaatacctggtcggttcctgatcctcatcttaacccctcactagtgttcttttccctgaagatactttcttcagttggctgctggttccttagaatttgtctgatcttgaaacatgagcttgcctcaggactcagcctttgatcctcttccctggcttcactactctctagggacctttaattccttccgtgttgacgatgccccggttttcgtttaatggctgccccatagtgtatttacccagtttcctatcagtagatctttgagttcatttggttttatgtttttaaaattaggatactgtacaagtattctcttgtacataatctctttgtgtgtttatgggagcatttttttaagtaaacatcctggaagtggaaaagctggatctgaagatatggacctttacattttaacagatattaccaaatgccccctcttgaagagattgtattaatccatacacttgctaagagtatgaaagggcctatttacccatcttctggccgacgctgcatattttccgttttattttgctttttactttttcttactttcttgactgattttaattgactttgcaagagcagatttctactagttgaagtgtaaagcattctgttcattattacaataagttctgtactataaatatcttcctcttgaggtctaaatagattgggatactgtgtcattaattgtagagccaaaatatgattcattacctagaaaatgtgaatttttacatgaagctgcagaactgagaacccatttttccctttcacggtgtcagatttgatactggttatcgctaatttaaattgcataacctgtcagcttcattataccagagcagtgattaccttgtttttaaaattgatactcttctggtggaggtttttaaaaggatggctttgaaattattgcaggatttctccatagaaagaaaattaactgaaattaagactattgtgaggagtttctgtttgagataatcgatttgaaactagagagttccaatcagtaacttttggaagattttagaacaagtttaaaaggtagtaacactttccatattgtgatttcccttggagaaggtagctgagagaaacaaattttcttcactaatgaattattttgacaggttgcagttttgactaaattgatgaagcaagtgcctcctgaggattcttcctccttatgtcagtgctgaatcagcagtagatgaaaaccttttgttgtcaaattttttttactctctccagtttcttttctgtggtatagttcatcacatgaaagggaattatttcatatatttgaaacatttagaaaatacaagttttggcaaactggaattcctatgataagttatttgtttttaagacaaagatttctattatcatagaagtgttaattcttttaaaccatcatttgctatttaatttgaaattcaggtttacaaactgcagttctacagacgctttctcggctcactgcaacctccgcctcccaggttcaagtgatcctcctgccttagcctccccagtagctgagactacaggcatccactgccacacccagctaattttttgaatttttagtagagacagagtttcaccatgttgcccaggctggtctcaaactcctgggttcaagtgatctgcccacctcagcctcccaaagtgctgggaattacaggcgtgagccaccgtgcctggctctcagacactgtctttctaaagcagcggcagatttggatctagtagcagtgtatagggatgtcctttccaaattctgtagtcagaatgactcctctgaagttgttgctaaaggattccttgcctatacattgcattagagatcctttctttaaaacatagacaaagcaaaggtaaaaaaagttatttgcctcttattaccaggatgatgagtgacatttacctggtgtaaaccatttgaaattcattttgtctttcatagcttattgaaagtatgttttaatttagtattgtaggatatgtcttttttcacactggaaagatagaagggatactttctagccttcagagcagggatgcccataataatagcagctgtcatctcttgaactcttattacctaaagtgataggcaccataatgagtcctttacatgtattatctcagtcagtctttgcaaacaataaggactgttattcctatttggagataaggatgttatctctaagtaatcttaagagattaaataatttgctcaaagtgcacagctaataagtggtaggatttgcatcaaatgttctgaccccggaatctatacccttcatgaccgagctctgctacccaattaaattctccatgtaaaagcaaccagtggaagttgacatgggctcatacctactgtgtacagttttaggcttagtcctggacctctggtcttctcatatacctctcatgcagcattcttaggcatacccttgaattcaagtgttatctgtgtactggagaatttttttttttttttttagctgtaactgaaacatgtttaagacattttcacttattttttgtttttgctgttttttttgtgtgggttttttctttgttttttgtttgtttgtttttttaatagccaccttgaatgtagcagtacctacccagtaacctactcctcctttagaattctgtatcttagtaagggcagccatctatgtacccctaacgcacctgggtatcttccttgactcaactttcctcttatccacacatctagaaagtggtaccatatctacctccttagaatcacttgagtacatccacatcttccattccattcccctctctgggctaccattgcttctcagatgactgttaacaacctttaaactggtcaccttgcatccagccttactttttacatactttccactcttttaataaaatgtgagcatgtcactcctatgcaaaacttttcagtgagtttccattgttctcaggataaaagttcaaactccttaagacatgtaaggtcttccccagtctgtcttcctcatgctgctttagcctcttctgttgtccactttgccattcatttgattcttgtcaccttagcaccaatctgtttgagtactcctacccaccccacccatgagcctttcattcactgctactcctgcacgcccttcaggttcaattgaaacctcagttcctgagaggggaggctttcctttccatagcatccatcacacatttgcttagtatctctcttcctggctaggcagtaagttgtgtgtagcaaagatctctgatgcacctcatttctagcacctaccataattttcaacacctaagagatactcataaataatttatagaataaattacagatgcagtctctacccttaacaagctcaaagtccaatgggaactagagtatggtaaagaagtaacttccatacatgtgataagtactctaataaaatgccacaggattgcagaggagtgtgtgagtggttagctttgccttggggggagcatttgccctttgtaactctgtattactgaagaaattgacttacagcattcagaaacaaggagagctgtgctgagcagtagaattgattcacttgcattttgccttattttttgcttactttttgggcaggagttttacagtagacctttaatattctaaggttatatatcaggaacttcagaaagtctaacctagacacagatgctatgtagtcagctagccatgctcactaaattgactaaaccaagtcctccctaatcaaaatcattgctagcccttttatgttcccagttacaaatcaggcatcatgaatctttgcttcaaattccaacagccaaaattgatggcattgaatccatgaataccagaggtgttgtttcatgtttagatttttatttcttgtcattccagctttgaccgccattgaaggcacagcacatggggagccctgccacttcccttttcttttcctagataaggagtatgatgaatgtacatcagatgggagggaagatggcagactgtggtgtgctacaacctatgactacaaagcagatgaaaagtggggcttttgtgaaagtaagtattgctcagtaggaggcagatctgcattgctttatgtctagggcaatgtttttaaggcctttttctagccatcctttttccacattggtcagaaatggccagcattgctgatgtcattacagccttaaagagtggacttaagagtgggaaacttggtgtatttattttcaggctgtcactcaagtcacactcacgttttatttagagatggttttccattggtatacacaggttgttttgttaaacccttcaggcagcctgataaattattaaacataaaacattttgggggcagtaaaggaaactgggccattatggagaaggttaatagtgattagaagaaaaataaataactttttaaaaatacttaaggtgaaatatgctataccaaggtaacatttgacaaatacagtgtatttaaccatctttagtataaatgtcattatagagatgctgactctaaggaaagctattttcaggaaaaacttcctaactatgaaaaaacaacagaaaatcttgaacataatcccttaaataccaatttttaaaaaaataatggctgttatagaatatttgggcaatcctaaaagagcacatcaaatatagtccatctttagatgtaggccagcgtgactgggtactccagttaatgcaccagaatttttttatattataagaagaatttgcttctgtttctataaatactggttctaatgaaatgtttgttttgatgagttcttacagtagcaaaataacttttgaaaaatctataacagttctatgattttcagtgttatatcagtttgaaaaattggtgaacttgaacattaaatcagtttctatatttaataaaaattttttactaacttgtattatatagttaatcaaatattttcaccttgtaaagatatacagtatttccaatagagctaaagtgtcctttgatcccaacagtatttttctgactactgtgttcgtatgtcttgaccttattttagctgaccttggcatattgtgttagtccattctcacactgctgtaaggaaatacctgagactgggaaatttattaataaaggaggcttaattggctcacagttctgcaagctgtacaggaagcatgatgctggcatctgcttggcttcttgggaggcctcaggaaacttaccatatgagatgcagccgtctcatatggtgggagcaggaacgagagagatgatgaggagcaaggtgccacatactttcaaatgaccagatctcgtgagaacttactatcacaagaacagcaccaaggggatggtgctaagccattcatgaaaaaccacccctatgatctagtcgcctctcaccaggccttacaggtgagagagattgtaatcaccagggattacaattcagtgtgagatttggtggggacactgatccaaaccatatcacatataatctgaaattttagttgaattatatttaaaaagttagcattaccaacagaaaagtaccctctaagagtggcttggtattggtatttctataaaaaagtgatttcagtgaattttatatatgtgtgtatatatatatatattttttttaagttttatcttgtgtcatgtaaaggccacacttaagtgtttttagaatcatgtttgggaatagtgaaagatcattcattttgtttgtatgactgcccaaaagaaagaatactaatggttgataattgatagaattaaaatccatttaaatgcatctgacgttttgtttttagctgaagaagaggctgctaagagacggcagatgcaggaagcagaaatgatgtatcaaactggaatgaaaatccttaatggaagcaataagaaaagccaaaaaagagagtaggtagcactgctaagtccacttttcccccatgacaggccattactgagacaaatagcaactacattctttaaaaagtgcactgccagagacgcagaagatttttttaagttccattacaaaaaaatgtaatataacttacgggcattagtagcattgcttttaccacactttagttaaggtaaaattgttatactgattacagtaacaaacaatgagtaaaatggcaatgattgactcaagttgtagtagtttctaagaaccaagcatgcatatactatttagaattcaaaatgacataaaacaaaaagaattgttgtcaagtacgttttttgtttttgctttgtaatttttgactggaatttaggaatttgtgcttggaaaaaacagaacaagtgattatctcgtaacatcttatgtccttttaatttcagctgacatttttatagtctgcaaagatttaaaaagaaaattgcaacagttattattagatcgtatactggacaccatcatattctcttattgcaaatcggttaactttttttaatagaagtttttaaaattactgttagtataattagactatttcaagatattaggataacagggagaactggtaccttatatgaaaaacaaaatagctagccaatctgggcagcatagtgcaaccctgtctctaaaaaaaatttaaaaattagccaggcatgatggtgcacactgtggtccctgctacttgggaggctgaggtaggaggatcacttgaacttggaaggtagagaggctgcagtgagctgtgatcacaccactgcactccagcctgggcaacagaggaagaccttgtctcaaaaaaaaattaaaaaaagggatgttttttacatgtataagtaatatgactgaatagaaataagattatcagagggggtggctaggcgtggtggctcacgcctgtaatcccaacactttgggaggctgaggtgaccaggagttcgagatcagcctgaccaacatggtgaaaccccgtctctactaaaaatacaaaattagccaggcacggtggcgcacgcctgtaatctcagctacttgggaggctgagggaggagaattgcttgaacctgggaggtggaggttgcaatgaaccgagattatgccattgcactccagccgggacaacaagagtgaaactccatctcaaaaagattatcaaaggggttttgtaacataaggaaattatttatgttgcgttttagtagatcaaaaaaacttaatggcagtttcaaaacattactaatttggtttttaattgtttacatttgaagagcatatcggtatctccaaaaggcagcaagcatgaaccataccaaagccctggagagagtgtcatatgctcttttatttggtgattacttgccacagaatatccaggcagcgagagagatgtttgagaagctgactgaggaaggctctcccaagggacagactgtaagtacattctcagtgaagaatctctctgcatgtaacacttgttagttttaaaagcagtttactctctatgtcctgacttcttttaaaaagtcagactggaagataaataccaattttgtggctgaccattttatcagtcttcttggatagtctttttccttagtctgggaacatttatggtcatggaagacatttttgcagttgtgccttgctacaattacatttgtactcttccaaattagatctgtagagaatgaaatatgaagataattactttttatctgaaattactcaccattgcatttttccaaagttcagatgttgcagctcatgttaatcttggtgtttttttaaaaaagtattttattacagaagcagtacatgtccattataggaaactagaaatacaaactaacaaaactaagaagtacacatcacatatgtaccacccaaatatgagtaataatatattagtgtgcatgcatatctttctgtaatagatctttctctttgtgtatatatacacgatatttttattaaaatgagatatcactgtctattgttctggaacttcaccttttcatcccagcacattttaagtcatataatacccacactatgttcatatgatgttgaacccaaaaattttctttatacctgttttgtccaaaccagtattcaatccaggactctaccttacatttggttgttatctagtataccccaatgccttttttgtctatattagagatagggccagtttttctgcagaatatcctacctcagtttgttttcatggtggcttttagtttgtttcttcatcacctgtatttcctgtcaataggatgtcacagctaaaggctgatgaatacaagtaaaatatttttggctagactacattacaagggatgttctgtattctacattgtatcacatcagttgctaacatatctggttgtttccccattaataatgctaagattgacacctggatttagggggccatcatatttatttaaaattccttcaataattcaagcttattcaagctgcgagacttgcttaaagataagtgaaatatctaatcacaagggaagtctgttttcaaactatataaacaataacaggagtcataacagttgttttcttagaactgaatacctaacaattctgcagctctttcctcggtattttattataagcagattatatcttaattgttcccctttgttttcaaaggtttttctcttctttgcgtgaatcagtttatataaaaacatatatattcttattttcagaggtattctgctctgaagaacggttttactttataaggcatcagttccctctaatattagaaccttacaaagccacagcactttatatgttgcaaagcaccctctccatgaaaattagttctagttgatgcaacagacaaaacccgcaaatcacagtggcttaacactacagagagttatttcttgctcatgctagatttgatgtagctctcctgttggcatcactcttttctgagtagtgactcctggtcatgggctgtttctattatgtagctacactgattgctacacggggcttccatgccatgatgaagtgagaaaagagagcctcaggattcattagggtgttttcaggcttacatccctgacagccataccccaggcatgtgattctacggagaggctggaaaacgtagaggagctcatgatttcagtgagcactccagtctctgccacacctgcctttgtcatgttagcttatactttcctatcatcaaggatgatccatagaaggcaaagggttgaaaaggttgaacttcaccaatgcattatttcttccatttttgtgtttttatttttagaaaatcatgtgtgctctaacattgtagagcagcctttttcccttgacctcttcagcttgaccccttgctcctcctttttatatctgagatagtttatcttggtaattcatatcttgtctgttttcatagtgtattcctttctgcatatatagagaaatatgctgatgtacctatagcgggagttgtcttcataatggctgttcataaagataaagtcatgtttacatgtattcagctttgtctttctagttagtattaaattgtcctcaagctaaactttttgtcttgtttaaagttacatttggctgggcgtggtggctcatgcctgtaatcccagtactttgggaggccaaggcaggcagatcacaaggtcaagagttcacaaccagcctggccaacatggtgaaaccccgtctctactaaaaatacaaaaaggaaattagctgggcatggtggcggcacctgtaatcccaactactcgggaggctgaggcaggagaattgcttgaatctgggaggcagaggctgcagtgagccgagattgtaccactggtctccagcctaggcgacagagcaagactctgtctcggaaaaaataaattaataaaaataaagttacatttaattgtggccgggtacagtggcttacccctgtaatctcagcagtttgggaggctgaggcgggtggatcacttgaggtcaatagttcaagaccagcctggctgacatggtgaaaccctgtctctaccaaaaagtacaaaaactagctgggcgtggtggcatacgcctctacatagtcccagctacttgggaggctgaggtgggagaaccacttgaacccagtgggcgaaggttgcagtgagccaggatcgtgccattgcactccagcctggatgacagagtgataccctgtctcaaaaaaaaaaaaaaaaaaaagccacaaataaataaaattttttttaaaataatgctacatttaatttaattgtgtaatgtgtaaaactctgaatgcttttccaaggctctttaatccatgtttgtacatacttgaattcaaatcttttagcatttaaagactcttgcattttttcatagtatataaaactgtgtctgtctgtgtctgtcttggataaaccttcaccaaagcaagatttcttacttttatcatctatttcaggctcttggctttctgtatgcctctggacttggtgttaattcaagtcaggcaaaggtaatactattaaaactttattgcatattacaatttgaattgaataaatgcgtgcctatgttcagttaaacatgttttgttctttcacaggctcttgtatattatacatttggagctcttgggggcaatctaatagcccacatggttttggtaagtagactttagtggaaggctaataatattaacatcagaagaatttgtggtttatagcggccacaactttttcagctttcatgatccagatttgcttgtattaagaccaaatattcagttgaacttccttcaaattcttgttaatggatataacacatggaatctacatgtaaatgaaagttggtggagtccacaatttttctttaaaatgattagtttggctgattgcccctaaaaagagagatctgataaatggctctttttaaattttctctgagttggaattgtcagaatcattttttacattagattatcataattttaaaaatttttctttagtttttcaaaattttgtaaatggtggctatagaaaaacaacatgaaatattatacaatattttgcaacaatgccctaagaattgttaaaattcatggagttatttgtgcagaatgactccagagagctctactttctgttttttacttttcatgattggctgtcttcccatttattctggtcatttattgctagtgacactgtgcctgcttccagtagtctcattttccctattttgctaatttgttactttttctttgctaatttggaagattaactcatttttaataaaattatgtctaagattaaaactggttctaagcaaaagcccttataatttttctcttatgagtaaaatgcacacacttcaaaaataaagtttatgacatctattttgattgctctaggaactatattatttatttccttgctcttagctatggccttcttgttgaagttgctgaatccattacctcaaaacctaacacttagcataaataaggtgttagtgtacttggatcaaatgacagcaaaattctgggtatgcttagctttatttgttccacgaagaatgacactgaagtacatgaaactgctgcctcctcacgtgaagttgttttacagggttacagatactgggctggcatcggcgtcctccagagttgtgaatctgccctgactcactatcgtcttgttgccaatcatggtatctatgtttccccttttaccttttaggaaaaaaaaataaatggaattaactttaaacatttctatttttattgttctatttgaagtattataaatggctcttttatgtggactcatctttaaactagttgaggttcagaagtacttttttctttatataattttgctttaggttctatttacgttgtgaaaaaagttcaatttattaatagattactgatttgcgatctatatagactactgtaaaaacagcttcctttaacaatgtgttcgtcaacgtttggcagctggaattgtacttctctctctctggaacaattcttctgattttcctccaccttattgttttatccctctatttcagttgctagtgatatctcgctaacaggaggctcagtagtacagagaatacggctgcctgatgaagtggaaaatccaggaatgaacagtggaatgctagaagaagatttgattcaatattaccagttcctagctgaaaaaggtgatgtacaagcacaggtacgtgtttgaacatctcaccaaatatctttactgcattgtatattttaatctgtgggggacgggagcaagcacttatatctgtaagttacattttcattgccctgagcaattatgaactacatattagaatcacctgagccccttaaaaaaaaaaaccaagagtctcacactctcaggagattccatttgggttagtgtgggatggggcctaggcattgagggttcctaaaactgtccaggtgactctcccgtgtactgcccctaaaaaaatcactgcttgaacagagcagcattaacaccgatgatgaaggctgttactggagtcaccaatgatgaaaactgtcactttctctaaacaagaagtccctggaatatttgcaatatcagatgctcttcagagctatttaccattcgtgtttctttggctcatctaaaatcataatttcttcaaggtcaagaacagaagtaagctcgtttaatggaagttgtataatgtccgtcaaagtaccatgtgtgcacacacaggtttcgtggcttcttttgatattaaaataaaaagaactttaacatttatatttttttccactaagtttgcaattatttctaatttaggacatgtacagatgagcattagatacttattaagaacagttggttttaagactagcagtggagtcttaaggaaaaaaaaacgtagtgaaacgtagatctaaatgttagctgatagaaattataataaacttgttcaattaaacatcttatttttacattattgtaaaatttagtttacttaaaattttctgttttacttgctttctgtgtatcttgcttgttgtgtttactcttctctcctttcttgcccttttttggttgagtgctttttcctgttgcatctcttcccctctgccagcatgatgctactcttgtagtggttatctagcgatcacaacatgcatccttgacttaccaaagtctggtacgatgagcacttttaccatttccaggacagcacagagatctcagagtattctgtgtgtgtttgattttatatattttggtaccatgagatactgttgttttgtacagtccatattaatttacatttattttcaaatttaccttttcattgctttttatttatttttttattttttattttttgagacagatccttgctctgttgcccagtgccactatctcagctcgctgcaacctccgcttcccgggttcaagcgattcttgtgccttaacctccccaagtagctgggaatgcaggcatgcaccaccacacccagctaatttttgtatttttagtggagatggagtttcaccatgttggccaggctgatcttgaactcctggtctaagtgatcccacccacctcagcctcccaaaggctgggattacaggcattagccaccacacctagccagctctttatttcttactgtatctcccagcttctagtaagtttccttttttctgaagagcacccatttgtgtttcctttagagcaggttcactggggacaaattcagttttttttttgtttttgtttttgttttttgagacggagtctcgctctcgcccaggctggagtgcagtggtgcaatctcggctcactgcaagccccgcctcccaggttcatgccattctcctgcctcagcctcccgagtagctgggactacaggcacccgctaccatgcccggctaatttttttgtatttttagtagagacagggtttcaccatgttatccaggatggtctcaatctcctgacctcgtgatctgcccgcctcggcctcccaaagtgctgggattacaggcgtgaggcaccgcgcccggcccaaattcagttttaatttatgtgaaaatgcctttatttcacttccactttagcaggatactttgtgtttttgttttttgttttgtttattcatttgtttgttttttaagacaaagtcttgctctgtcacccaggatggagtgcagtggcacgatctcggcacaccttaacctctgcctcccaggttcaagcaattctcctgcctcacctaccaagtatttgggattacagatgtccatcaccacacccagctaatttttgtatttttagtagagatgggatttcaccatgttagccaggctggtcttgaactcctgaccttagatgatccacccacctcagcttccaaaagtgctgggattacaggcatgagcccatcgtgcctagcccgttttttgtttttttgagaaaacatctctctctgtcgcccaggctggagtgcagcagcacaatcacagctcactgcagcctcgacctctccaggctcaggtgatcctcccacctcagcctctcaagtagcagggactacaggcgtatgctaccacgcccggctaatttttctatttttttgtggagacaggattttgcgatgttgcccaagttgttcttcaactcctgggctcaagtgattcacccatgacctcccaaagtgttgaggttacaggcgtgagccaccgcacctggccgcaaatggtactttgcaattacaagtacacgtttttacttttcaaaatttttaggttaattaaagtagaatagcattttcaggagttaagactaaatctttttgttttttgagtcatgaacagaagccattttacgaccaaatcatttcttgttggtctgattttaattgtgtgccagatggtaccacttacttttgccttgtttgtgatcattttcaggttggtcttggacaactgcacctgcacggagggcgtggagtagaacagaatcatcaggtaactaccctgttcctagggctttgcatctcagttttagcaggaaatgatgttcccaatgtatttcttgctaagtcaataccagtatcaaacttctgtcatttaaacacccatcacaaatgagctttcaagatgtaaccaacccctaagaaagctgaagaatacaaatattagtacctactatgtgccattcactgctaggcattcaccatgcaatattggacaaaatagttttggtctttgaccttttggagctttaactttaataggagtattagatattttttaaatgatcacaccaaatataaattgtggttattcttacaaaggagatttaaaagatacaataattggttaatgggtaggaggtaccgcttgccagggaagacttctgtaaagagaagtagaaaacatttaagttgaccctggagataaggtccttccaggccaaaaagaacggtatgtgcataggcccagagacaggaaggaatatggctagtctgcccatactacaggaatatgactggtctgcccatagtacatgaaacagaactgagattaagcagtgcctgatcacatcagcatatccctgcagcacttcaaggagctacaaagatcagcatgttcagatttgaaaacaatggctttggctgcagtatagaaagtgaattagaagaccccaagaataaaatcaggcagatcagggaggggaatattcgagaagttcaggtgagagagaatgtggcttggactagaactacggtaaaggaagatagtagtggattcaagatgtatttggtggtaaatgtaacaggccttagggatggatgggatataagtgaaggggagctgatatcttaagcaaccagtaagatggtattgccatttgcttaaattgagttgctggaggagaagcaagttgaggtcaagaagagaagattttagggatatgttcaggcattggatagtgtgttcagaggtagtcgaatagactggattgaagctgaaaatataaatttaggagttgccatcatctcgatggtgtgtgaatctatgggaatagatgagattgcttagagaatgcaaagtgagaatggagtccaaaactgagccctgaagaactttaatgttcagaagtcaactgatagaaaaataaccagcaaaggagacttaggtggtacaggtagacttaggatggaaaccaggagagtgtgacatcttgttagccaagctaagagtctgtcgagaaggaagccatgatggactctgccaaatgttgcagagaaaggtggagtgaggtgagctgaaatttagattggcagtatgaagatcatcactggccttgatgagctgtctttttgatgtagtgtatggaagccaattaagactagattgcagagtgaattgaagtgcatgtcaccaatttattcgagaagcttggctgtgaaggaaagtagctaacagaacagtcatcattggagagaaattgggggtctaaaggagatacatatcttgtgtgttttggtttgagttttattttttatttattttatttatttatttatttattttgagacagggttcactctgttacccaagctggagtgcagtggcgcagtctcggctcactgcaacctccacctcctgggttcaagcaattgtcctgcgtcagcctcctgagtagctgggaatacaggtgcatgccaccatgtcaggctaatttttgtatttttagtagagacggagtttcactatattggccaggctggtctcgaactcctgacctcaagtgattcgcccgtcttggcctcccaaagtgcagggattacaggtgagagccaccgtgccctgctgagttttattttttgatgatgagattatagaatgtgattgagggggaactggttccaaaagagggagaagttaagtcagcaaggaaaataagaggaataaccaatggtacaaggtccttaacaaaaatgggctgcaatacagttgagagtggtgatgatgaatttctgctgatgctagtgtgtttacttaagtgatttttaagtagggtcaagaatttttctctaaacagtacaagaggaatgtattcctttagacaacaatgaaaatatgctccatgtcttggaaagacttctagtttttcctttctcccaggttatcattagagaaatagaccaaagaagtcaagctgctcttaaatgtcttttaagcaggctgatgttcgctttgcctgtaagtaacaggaggcttgttgtaccttacgtttaggcagcacaagaaatttctttgcatctataattatgcagatgacttaatgataaatggtactgttatttggtaaaataaaacttctagatgtactgatttctctttcaaaatattggcaactgggtattcttgtttttaaagcactgtaatataacaagattttttaaatgttcctgaaataattattttggctgaaagtcaaaagcagattctgttaaaaactaattattttaataaattcttttctcatagagagcatttgactacttcaatttagcagcaaatgctggcaattcacatgccatggcctttttgggaaaggtactgtacatcctgtgaatgttttatgtaatagcaagaggtgtttgcataattagcatgtattgtgttcaggatctacaatttaccaaaaataaattggaaataagatttctagtgcaagactattatatcttaaagtgctgttctgaggcattttcttaggcaacttaaatataacatagtgtttgcagccaggcgcggtggctcacgcctgtaatcccagcactttgggaggctgaggcaggtggatcaggaggtcaggagatggagaccatcctggctaacacggtgaaaccccatctgtactaaaaatacaaaaaattagccgggtgtggtggtgggcgcctgtagtcccagctacgtgggaggctgaggcttacagtaagtcgagaccacgccactgcactccagcctgggcgacagagcaagactccatctaaaaaaaaaaaaatagtgtttgctcatcagtatgttaattcttcattgaaattagctctcactgagctcttactttttgtgtattgtatgcaataatgaggaatgtattcttgatgctgtgcggttttttgctaagactctcacagttgtctgtttccttccatgctgaatagaggcaattagagtttgttgaaatttatctgcagagtttttaattgtcttaaatgtgatagccatgacccacctcttctcattgtagctgtgttctcaatcaagggaacagaacatttaagtctagaaactttataaataaattccatatgtcatggaagaatctcaaaactttttcattattttgaaacatagtataaatcaatgggtattttcacttataactaaatcctaaagtaaggaagtttagatggaatatatcacaaaggtttttacaatagggaaatttcatcatgatttgcctcatgatcatactagtaattggggtgtggtaactacatttaaatattccagctgttccatagcatagaacttggtatttccctctgtttttgttaagcatttaagaacgtttcattcctcctcttttggttcttgctctgaattactgtcattgtctttaaaaactattttttacatttattgtttctttaacatatatgtgaataaagacagtcttgaccattctgtttttctttctcttggccctttatcattctccatacctgatgctctaattgtttagtgtttaaaccctcttcaagtaaaccttttagttacttcgtttcctgaacttaagacccacttgtgatcttatcctggggaaagtagtggtagaggagaaagaagaatgaatgccgcaagcagcttcccctttccttgttgaatcactgatctgatcctaagcaacttactaaccatttgacttccctggaatagagtgagaaaaatgattcatgttgggcttaaagatttcttctgagactaatatatgagctgattttatgtattcatgtttataaataagtcataaatttgagatggcaacagagtatataattactaaaatgtttgcttttaagagtttgcttttaattcttttgttttttttgtttgtttgttttgttttgatatgaggtcttgctttgtggcccagtctggagtgaagtagcaagctgtcagttcactgcagctgcagcctcctgggcccaagcaattctgctgcctcagcctcctgagtagctgggattacaggcacacgccaccacgcctggctaatttttgtatttttagtagagacagggttttgccatattggccaggctggtcttgaactcctgacatcgggtgatccacccaccttggcctcccaaagtgctgggattacaggcatgagccactgtacccggcctttgcttttaattctaaaatatcctgtggggaattctaaattttttggaaagatttaatgagatctgacaaaactcaaaggagatgagaaaggagaaaaatgtaattggagagagggttacagctcttactgaaattgggatctgttttccagatgtattcggaaggaagtgacattgtacctcagagtaatgagacagctctccactactttaagaaagctgctgacatggtaaggctttgtctcagtgtactgaaatgtgtaccatattactaatattttaataaatgaatttgttatattaaagggttaatcataaccaactcatgctatacattattgaaactgcatattaagtatgattcatgtgaatgtattaattaaacaaagccctcccgataaaaggcaatttttttagggaccaagttgttgatttttaattgtgaagtttcactgagaagtttcctaatcggggaaatactgatttttagtaatggaacttgaacttatataatctaccctatttgtatcacaacatgaaatttaaaagcttacataatagggtacttttgataatcatagtacataatttaggctttctttggctcagaaaactgcatatgagtacctgaaatcttgtatgtcttcagtatgtacacttacctctctgtcaactattatacatgttactgtagttccagatgtcacttgaatgcttcccaaaggaatgctatgacaatctttttaaagatgtcttctgtccctctgagtttaggcaaattctagatttttttctttctagtcccaaaacagtgattttctttgttccatgacactccaataatcctaagtatatctttgtcacctgatagcagcattgctattattacatgattatgctattattacaaggtgttccatgatatcctccctctttattggagtgggatgttaccagtgaaaaactgcaaaaatgtgacctgcctttcattttgatgaaatacattagtcatgctttatgtcataaattcatggtacagatggtcataaagtaagtcaacaaaatgtaattctaaatgaatttactatttactctttttcagcaaattacccaaagcccccagatgtctaaaagtcaatattatgtttagtctgatgagaagaagaaagttttgttttgaattgaaaagtactaagacatgtttttgaatatgcttataaatgatttattttgcagttatttattcttgcctatttttgaatgaattcttttcactcttttgtctgatttctctgctttgcagggcaacccagttggacagagtgggcttggaatggcctacctctatgggagaggagttcaagttgtaagtgttcagtctgacattctctctttaatgagcagtcagctggagaggtagggacatgttccttaattagcttccagtcagcccaggtggggctgttccattgtaagcaaagctgaacctctttctgttgtctgagtttgtctcactaccaccccatacccgacagacaccatctcaactgtcttagaacagctctgtgtctggcactttctcccagaggtatggagttgtttcttgttcttccatctctgctctctaccccacgtcctctaaccatctctcaggacttaaacatctccttgcctgcttttttactcaatcctgacaaaatgcataactgccttccattgaggaggaggaaagctttctgttctgccctttaccccttctagctaccacctgtcttctcccagcccttcactcagagtcaaactaagctgctgtcattcactcttgagttcttagcaatcgaacttctgcttcatggaactatactctctgtacagatcaccagtaacctcctaaatgtcggtccaattgacattttttggttctacctcacttgacctctcgcttccctggtgttctgtctgtgtctgggtttccttggccattgcatctcatccttctgtgcagcctcctcatgttggatgtccctggattcacgttgcagtttccttctctatttgatctttccaagtaatatgtgcttttaatttgaggctgaaactaagagctaggtttaagagctaggtttttaatatctataggtattctctaacacaaaagacagtaatgtgttctcattttgcggccttctagtcattctaggacactaaaattcagtagtaacctttattttaacttttcttcttggatacatatgacctttgaagtataatagtcatagtgtttggtaaggtacacggaataaatgaataaggagataattttctttctttaattttaggaaaattgaggtttaaaaagggttgattggttagcagagaagattgactgtttcttaattcctggtctgatgttctactagtttttatgctttctgagagcagcatacaaattgtttcacaaaaactctatttacttttcttcaccaccttaaatattaatccccctatgacttaatgtatattattatctattataagaattagaaagtggtctttttaatggctctttgggaatatttttttatatgctttgttcatttttttaaataaatctcttaacttttgagtatgtctgccttttgagctttctcatcatatgacatctttttctacagaattatgatctagcccttaagtatttccagaaagctgctgaacaaggctgggtggatgggcagctacagcttggttccatgtactatagtaagtaacactggaattaatgatggatacaccaagatctaaattaagctgttttctactagatggcattatgatgtggaaatgggtgctatcaaattctggctggttaaatgttctcccagttcaatgatttgtacatcttgtttttcattgtaaattatattaatctgtatcagtgtgttagcttgtattagattcacatatttactcagtaagaattctttcattagagttttattcttcatatataagccttctctgatacttagctaaatcttaagtctattatctcgtgtgatttttttttttcttacagatggcattggagtcaagagagattataaacaggccttgaagtattttaatttagcttctcagggaggccatatcttggctttctataacctagctcagatgcatgccagtggcaccggcgtgatgcgatcatgtcacactgcagtggaggtaaggtctttcctaccagcttgtgtgtagggagttgatttgcccagcaggaaagtctgcgctttcaattctggtttttttgtatgttttcttctgtagttctagactcagcctacctagctttgatatactgagggaagaccgaggggtctgtgtgtaattaccatacttatttattcagtgtctccctattacaatcaactgtataaggggagatactggtgtctgcagtatctctagcacctaagacagtatctgataataatcagcatcaaaaaaatatataagctgagcacaatggcacgtgcctatagtcccagctacttaggaggttgaggtggatgaaggcttgagcccaggagtttgagaccaacctggacaacatagaaagaacctatctcttaaaaaaaaaaaaaaaagaaagaaagaaaaagaagttgaatgaatgttccaaaaaggaatgctaatatctcctaattggaaattgtctcttagctctctcttagacttggcactttagagtgacattgataaatgcttagcaaagtttctaaatctctgtgctttagtttactcacttgtcaaatggggcttttaacaggacttacctcctagggtggttcctcatgaatctcatgggaagattaagaatggtaatatacataaatcattacaacagtgcccgggcagagtaaatggtcatttttgtagtacaataattgtgtactgttttttttttttataaacctgttgacttctaaagagtaagtgaaaactttaaataagtatctcaaacttttatgtctgttcaagaaagctgccagaaattgaaggagcaagcttaatagtcatgtgtaaccaaagtgcataagtgattttctggtatatctttcttattttcttctactgatattttttttccccacctcacacagttgtttaagaatgtatgtgaacgaggccgttggtctgaaaggcttatgactgcctataacagctataaagatggcgattacaatgctgcagtgatccagtacctcctcctggctgaacagggctatgaagtggcacaaagcaatgcagcctttattcttgatcagagtaaggttcattttagtcctgccttaggtttagaatgtacgagttcacaccagtaaactgtttaatgtattcaaaaagaaaagctactaggaaacattctttattattgtaactggaactgaacacacaggcttaagttattaatattttactttagccatcaaagttagttttataacgagttgactgtagaaatggatttgacattcattttaaaattaagcactttgcataaatgtatttttcaaaatacagtggatacaaaaatgccattttcccaacactgtagaagagtgactcagtagtctcatgactggttctatagatacaacatgtttcacaaagtagtgccctcttgcatccagtgattgctttgaactcactattttagttcagtaattaatttcagtatttgttttaatttttatatcctaattcttgtttaacttatgcttcacctatccttcctactttgcaaatgaaaattaagtctagtgccttttcttaaatgcctgatttgtatttcatttcttttcctgtaggagaagcaagcattgtaggtgagaatgaaacttatcccagagctttgctacattggaacagggccgcctctcaaggtaagtgattaattctaagataagagtttcacccagggacctccctatgttgtttatctcccatgaacattaaatcatgaagccgagtactgtggctcacgcctgtaaccctagcactttcggaagccaaggcaggaggatcacttgaggtcaggagttcgaaaccgaaaccagcctggccagcatagtaaaaccctgtctctactaaaaaaaaaaaaaacaaaaaaaattagctgggcatggtggcaggctcctgtaatcccagctactcaggaggctgaggcaggagaatcgcttgaacctgggaggcagaggttacagtgagccaagattatgccactgcactccagcctgggcgacagagcgagactccttctcaaaacaataaaataattaattaagcagagatactgtgacttaatttgtttgcatattattggtatttattcttaacagaagtttctagagccagagtttctaaattgggttgtaaagtctttgtactacacatttccatcaagctatgattcactctttgttttccagtttgaggccagtatactgtgtgaaatgggaattaaatagaatgtatgatagaacattagtctgaaacctaagagacttttctttttcttttgaatatttattttttatacatgttcctttcaacattctctgcctgttcccttctccaaacctaaatggtcaagctggactattttaaaatgtaaatgacattataaagtagagcctgatcatttacataggagtgtttgtgaaagaagggagtacaggttgagtatcccttatctgaaatgcttaggaccagagtgtttcagatttcagatgtttttgttttttttgtttgtgtttggcatatttgcacatacgtattgtttgagcatccttaatctgaaatctgaaatgctcctgtgagcgtttcctttgagcatgacctttgaatgtcatttcaggttttggagcatttcagatttcagctttttgaattagggatattaaacctgtccccctacacacacaccaacttggttttacctctctgtattccaaagccttctgcagaagagctacacttctagtttaaatttttactggactttataacttggctgaaaggatttgttacaaagtttgtgtactatgaattaaaattctttgttttatgtaagcatgtcaatgggaggagaaaaaagtttgatctgttttaaacatactttatttattggcagttctgcatttaacttttgtttaaggctatactgtggctagaattaagctcggagactaccatttctatgggtttggcaccgatgtagattatgaaactgcatttattcattaccgtctggcttctgagcagcaacacagtgcacaagctatgtttaatctgggatatatgcatgagaaaggactgggcattaaacaggtgagtgtggcttccaaacacgtttgaatcacataattgtgattggggaaaatacttgcatttgtatagaaaatagactttccttgacattcagttggatttcaggccactaaattatgggactgatttgtaatatttcagaagactgcccttccatctctcatcttccagcacgcacagatactgctatccacgctgttttatttagggattaagctgaagacagactcatgaaaatggaagtgcagtgcttcctctgctgataactacttgtttgagaaactatctgtccatcgtcagccaaattctatttttttcaaattattttgaaatgaattaaatgtattctactgataaatttatttctgattcttacacttgcctaatgaagtctgtcattctctggactcatgacttaaggtttttcctgtgtgccctcaaaagaatttggaaaaactacagacccccttgtacatttttaagttggcatttaaattttttcttaagtttcaaagggtctaagttccagctattttaagcattaacatttttaaataaaattaattacccttaaaatatccaatagaatctaaataacaataatttaatacccacttaccattattaattttttagaaatatacaagcaagttttttaattgaaagctaggtcttttcctgtttccctaaatttatgttttctaccacgacttctgtagaatgtaatactaatgtattgtttttaatgcttaggtcttttattgattactgtatcatacttacctgaaacaaacaagtgtataaattcattttgaattttattaccagtgatctaagtgttaagaaaaattcatgagatattactagtcacagttggtcagttaatgcattgttgatcaaatctacaaaatacattttgataaaactttgctttttgtattattaattgaaaatgcatcttttaatgagataaatggagtatttgttaaaaattgagatttcacattaattctgtttttcatttttttaaatgtatgactagaatgtcatgtatgtgaaaatgggaagaatttcactatagcatggtcacttaattcttcaaactaccttaagagttagatgccaaaaatcagagtgacttgtcattagaaattatttttaatgatcaatctcctgactacttgataggtccctcttcagttgtgttgaaagcaaagaattggaaaccagagacttgtgaaagcatgcattccctgacactgggacctttcacttttcttattttctaggaagagtacaaaaggctttaccaagacttatgaaataggctgttaattatactccttcctgtgtcacttagaggccctttgttgacctaaggattgagggaaagttgttcatttttgctaatgcggtattttcttgacaaaatgctgctgctttgttcacatttggacattttcttttaatttcagtatgtaaatatttatattttaaacttaccttaatacttagaatattactaatattagatacttaaatatagttcagtcaaggctcaggagcagcaaactcagtacattcaacttctggaagatctctgccacttaatgtagtaactgaagcttctctttattgtcaaaccagtcatccagtgtcccaaattagacttagcttctatcagaaaggctgacggatttttgtcgttttttttaaatggagatggggtaccactatgttgcttaggcttgtctcaaacccctggggacttaagcgccttggcctccaaaagtgctgggattgcaggtatgagcccctgcacccagctgactttatttttaattcaagtgaagtttaacatgactaatataaagatcacatgtaagttatggctttcatggagtacatctagtaataatttactgactgtagtcaaaattaaaatgatataactaatctgtttttataatagcttataaaacaagaaaatgtgttctaatttaatttgtaatacactgtatagctaataatagaaattcttgtgaataaagaatatgataaaaggcatagtactcctttgataagagtagggggagggaacttttgtttagcttttgagaataaataatcatttatgaaaataaataatcatgtatgaaaatcagtaactccattactttttttttttttcggtgagatggagtctcactctgttgcccaggctggagtgcagtggcacaatcttggctctctgcaacctccgccctctgggttcaagcgattctcctgcctcagcctcccgagtagctgggattacaggcgcctgccaccacgcccggctaatttttgtatttttagtagagacggggtttcaccatcttggccaggctggtcttgaactcctgacctcatgagccacctgcctcggtctcccaaagtgctgggattacaggcgtgagccactgcacgcggtcccattactttttttataagacatcgtgatcaccttttctactttttttcttttgaggtttaaaatattcatgctactaaaaacaatcccccatttaatatagttaggaaaatattaaatatgaggattgactataattggaaaaaatcatcatattatttgataagttttaattacatactagtgaatctatttaattaccctagtgaatcatccaatgtatgaatcacatgaagtttgatccatgatcttgaaaaatatagcagtcgaaaaaaccatttgagttatatttttctaaaaactcagacactaaccatactgttagcattatttgaagatgctcttctttttaaataatgacacaccctaaggacaagaataaggaatagctgaaaataactgcttgtatttaaatatgtttggagggggagtcatttttggtctttaacctttcttcctcatatctcatggaattctttcttaagagtttggtattctttgataatagggagtagaagtgagatttttaagtgaaaattcccaccatcccattctattacatatctgaattcagaacactccagcctgggccaaaattaagaatgcctggtttcaccctttacagaaatatatctaacacagggaaacacaagatgccctaataagggtttataattagtcaataaaggagccttctccagaaccagtatttcaaggtatctcttccggtggtagcccctgaggtttctacaccccagggcaatgcacttgaggaaagagtggggtagatctcttccggtggtagcccctgaggtttttacaccccaagacaatgcactggaggaaagagtggggtagataagggctgtgccttcctttagcaaagcgaagcagagaaacgttgctgtgcatacaggcctattctcagcagatccctttcaggaaaaagcacatatggaagctgcagaactgcagaatcgagtcccttaacatgtccatgcaagtacctcttgtaaaatctgtttctttttttggaaacagggtctcactctgtcacccaggctagagttcagtggcaccatctcagctcactgcaacctctgcctcctgggttcaagcagtcctcccactcagcctcccaagtagctgggactacaggcaggcgccaccacacccagctaatttggcttattttttgtagagacagtttatgttgcccaggttggtcttgaactcctggcctcaagtgatcctcctgcctcgctctcccaaagtgttgggattataagaatgagcccactttgggaggctgaggcgggcggattacgaggtcaggagatcgagaccatcctggcgaacacggtgaaaccccgtctctactaaaaatacaaaaaattagccgggcgaggtggcaggcacctgtagtcccagctactcgggaagctgaggcaggagaatggcgtgaaccctggggggcggagcctgcagtgagccgagatcgcgccactgcactccagcctgggtgacagcaagactctgtctcaaaaaaaaaataaaaaagaatgagccaccgtgcctgtcatctgttgtaaaatcttgagtgtttctaccccactttgaagatcactgtccagaactgaaaccagacgttgctaatactgattgaagttttaagtagcaaaaaattagtgtgagtttcagaagtcgcccttggaaatctctaggttaacagtgttaatgcatagatatatggctgtatgcagcatatctacacagcaaattagatgttatgttgggggaaaatgagttttttaattaagtttttcaatattaagcagttagataattaaacgaattttacccaagtaaagcttggcatttttgtttaggtgagggaaactcattttaaaatgaaaacctcaaaggtaaaataaattcgtctaatatgttcactaaatatttttacttattttgacaagaaatgcatttttgtttcttacctgtattataggatattcaccttgcgaaacgtttttatgacatggcagctgaagccagcccagatgcacaagttccagtcttcctagccctctgcaaattgggcgtcgtctatttcttgcagtacatacgggaaacaaacgtaagtggtccgtacctcttttcattaaaatataaatgatggaaggtctgtcctggaggtttgtttttcaaaagttgagaagcacagggaagagtggtcctgcaggtatcgggtgtgttcccttctcctcagctcaggtacccgaggaccttatcaggggagggataaatgcaggcataaagcagctactgcagtttttaggtagcgtttgacacttcctgacgctaaagcatttttcatggaggcagatgttttctggtttagggaaaactgagactaactcatggcagtttgaaacagtatttaattcagtaaacattaaatcagatgactcaaaccagtcccttaaaaagaaaaggaaaaaaaaaagaagaatctgagaacctccccaggttgttgtacttcagattcttccgatagtgaagcattaagttgaaaacaccacccaaattttcttctctaaaaatagcgtgaattatttaaataggctaatggaagaacctatataggaagtgggttacccattttcttcaaaattaccaactttagttggcaatactggtatgtaggtactcttgggttctgccagctttatattttgtttccagtactatagttcctagaatggattaactggtagagcatttcactctgaaagccctaagatgttcagagcccttgtttctaacataggcttattcaggacaaggaaagtttcttcaggaccagaaaaggatgatgtttcacccttttgttaatgtctttcagttttagattcaagaatgggctttccctcatgtgtgtcacaggtataaatgtagtccatgctgctccagcatcagtgaaaagaaatggacttgtctagtccatgcagctgaagtcctccacagatagggttccagagcactggtcttgtgggactctggcctcccagtcgcttccacatgtgtaatgtcagttgctataattgcatggtagcatgagtcaggtgtgctgtaaccgctgccaattgaaacaatctttgttcctttaattaaaagctgatcgtgtggcagcctcctctttctctttcagtaccatttcagacctttatctctcacaatttttattactaactgttggttatagtctaggacttcatcttataatatgctgtactgggtatattgtatctttgctgttttttttaatacagaagtataaagaagacagtaaaaacgccccataatcctaccacctagttattccaactaaaaagaaaaagagagtataagactaataagtatcgatcataagaaagtcaaacagtacagaagaacacaaatctcccatcccagattcttccccagagaacacaattagtggtttcttgtcattttttttccagaaaaatttagcacctgtacctacaaacgtgttatagagatctttcaaatgtaattttatataaaattataccccatgtttactttcttaatgggtaagtataataaaagtcagaaagtatcagtgatactaaaacaattaaaatattataggctaagaacataactttcaggtttcaattcagatgttaaatattttgtgttttagttaaatcctaattgagaagcattattcattcagctattaaatgtttgaattcctgctattttcaattacatgggaattgtgaaatggccccactgtcatggaacagagctttccagctggtgtgctgtcactgccagtaggttcgctgtgccaagatactaatttctccccttggctcaccactgtttttttcttttttctttcctgagacagagtcttgctctgtcgcccaggctggagtgcagtggcacagtctcggctcaccgcaacctccacctcctgggttcaggcaattcttgtgcctcagcctccagaatagctgggattacatgcacccgccaccatgcctggttaatttttgtatttttagtagagatgggatttcaccgtgttggccaggctggtcttgaactcctggcctcaagtgatacactcacctcggcctcccaaagtgctgggattacaaggcctgagcccccgcgcctggccccagtgttgttttgttttgttttgttttccaaatattttctgtgaaaaatgattaaaattagcgtattggattactggtggaaagaacactgtcagacattttatattaagtgtcagctattataaattagtagcttaattcctcagacacattattttgagcttcagttgaaggcttttaaaaccgctttaaacacacacacacacacacacacacacacacacattgcaaaacgtttttaaaacaaattattttaatttctgtacttacttctggtgatgtaactttcccagttccttgcctgacattttagtgataataatggtttctatattattttcattaagattcgagatatgttcacccaacttgatatggaccagcttttgggacctgagtgggacctttacctcatgaccatcattgcgctgctgttgggaacagtcatagcttacaggcaaaggcagcaccaagacatgcctgcacccaggcctccagggccacggccagctccaccccagcaggaggggccaccagagcagcagccaccacagtaataggcactgggtccagccttgatcagtgacagcgaaggaagttatctgctgggaacacttgcatttgatttaggaccttggatcagtggtcacctcccagaagaggcacggcacaaggaagcattgaattcctaaagctgcttagaatctgatgcctttattttcagggataagtaactcttacctaaactgagctgaatgtttgtttcagtgccatatggaataacaactttcagtggcttttttttttcttttctggaaacatatgtgagacactcagagtaatgtctactgtatccagctatctttcttggatccttttggtcattatttcagtgtgcataagttcttaatgtcaaccatctttaaggtattgtgcatcgacactaaaaactgatcagtgtaaaaaggaaaacccagttgcaagtttaaacgtgttcgaaagtctgaaaatagaacttgccttttaagttaaaaaaaaaaaaagctatcttgaaaatgttttggaactgcgataactgagaaactcttaccagtccacatgcaattagacatattcagcatatttgttattttaaaagggagggttgggaggtttcttattggtgattgtcacacggtataccatactcctctccttcaaagaatgaaaggccttgttaaggagttttttgtgagctttacttctttggaatggaatatacttatgcaaaaccttgtgaactgactccttgcactaacgcgagtttgccccacctactctgtaatttgcttgtttgttttgaatatacagagccttgatccagaagccagaggatggactaagtgggagaaattagaaaacaaaacgaactctggttggggtactacgatcacagacacagacatacttttcctaaagttgaagcatttgttcccaggatttattttactttgcatttctttttgcacaaagaacacatcaccttcctgaattctttaaatatgaaatatcattgccagggtatggcttacagtgactactattataatactaaaactcagagaatcaaagatggattaaactcagtggttgatgaaagccaaaacctgtttgtactgttctatactattcaggtatctttttatttctgatagttttatattataatagaaagccagccactgcttagctatcatagtcaccattttctcactgttaacattaggaaaatcaaggctactatgcttcaggattgtctggttaaatagtatgggaaaaaaactgaagagtttcacataattacacacgtgaaataattaaagcttaaactgaatttgtatttcattttattgtcagatggtggtgttcaccagcctgtatcttgtctgagactgcattcgtatctgagcaggttttctatgcctactgatgtcagtatgtttatactaaccttcatgcttttttcccagaatccctcatctgccagaaaacttgaaaagtttattgcttgtagagttgtactgctttgatttttgaagttggggtagtagttagaactagatttaactagtctataatgaacatgaaggcttttatatatgaagttgtatacctttttgtgtttagagaattatgggaaacctggtaagcaaaactttcctcccagataattgcttccaaattcgaagagttagtcaccaagagagccatatgtatgaaagcgtatctgtgaaaggtaggaaacttaccccccctaagtgtaatgttgctttaggcaactcttgtaaatagtgagacttgtttggtctcttacatgtagagatttgagtgcagttggtacagtactttggtgtctccaccactgtcccttctccccgcttcaaaataagtgtaatccacggtagcagccacacttcctttagaaggaactgttataatttatttaaaagttgaaaaaccacccaagatgactaccaactttcacttttttcttctgccatccaccctcatttttcctttagcaagatttttatatctaactttccttccctccattgagtacgtgctttgagaaaacatttcttaaaacagtgtgtgccacctaaggctggatgggaaagtgcagtcttgttgttcatataaaaacacacttcttattagtttaccacttgcctttttctattgttaatgttctgaatttccttttcttggcttgtttctacttcattttaccctgggtcacttgctgccagcagtttgtgaatggtgtctttcaaataacttagttcttatggcttcacttaaagactgtctcaaaaatactttgctctcttcttcttttttgttcatgggacatggtacctaagcaaataggagttgggtttggtttttctcctaaaataatgctcaatacttacctaatcaaatggcatccatttgaataaaatgacaataactaaagctagttaatgtcagtgacattaaactaactccaggattcaggagttttaatgttagaatttagatttaacagatagagtgtggcttcatttgtccatggtagcccatctctcctaagaccttttctagtctgtcttcctgccttcgaacttgatgacagtaaaaccctgtttagtattctcttgtgcatttggtttgttggttagccgactgtcttgaaactattcattttgcttctagttttattttacagaggtagcattggtgggtttttttttttttttctgtctctgtgtttgaagtttcagtttctgttttctaggtaaggcttatttttgattagcagtcaatggcaaagaaaaagtaaatcaaagatgacttcttttcaaaatgtattgtttagcacttaactcagatgaatttataaattattaatcttgatactaaggatttgttacttttttgcatattaggttaatttttaccttacatgtgagagtcttaccactaagccattctgtctctgtactgttgggaagttttggaaacccctgccagtgatctggtgatgatctgatgatttatttaaagagccgttgatgcctccaggaaacttaagtattttattaatatatatataggaatttttttttattttgctttgtctttctctcccttcttttatcctcatgttcattcttcaaaccagtgttttggaagtatgcatgcaggcctataaatgaaaaacacaattctttatgtgtatagcatgtgtattaatgtctaactacatacgcaaaaacttcctttacagaggttcggactaacatttcacatgcacatttcaaaacaagatgtgtcatgaaaacagcccctttacctgccaagacaagcagggctatatttcagtgacagctgatatttgttttgaaagtgaatctcataatatatatatgtattacacattattatgactagaagtatgtaagaaatgatcagaacaaaagaaaatttctattttcatgcaaatatttttcatcagtcatcactctcaaatataaattaaaatataacactcctgaatgcctgaggcacgatctggattttaaatgtgtggtattcattgaaaagaagctctccacccacttggtatttcaagaaaatttaaaacgatcccaaggaaagatgatttgtatgttaaagtgactgcacaagtaaaagtccaatgttgtgtgcatgaaaaggattccttggttatgtgcagggaatcatctcacatgctgtttttcctatttggtttgagaaacaggctgacactattctctttgattagaaaataaactcataaaactcataatgttgatataatcaagatgtaaccactataaatatgtagaagaggaagttttaaaagaccttaagctggcattgtgaaggaacaccatggtagactctttttgtaaatgtattttgtatttaatgaaatgcagtataaaggttggtgaagtgtaatataattgtgtaaacaaatcctgttaatagagagatgtacagaatcgttttgtactgtatcttgaaacttgtgaaataaagattccacctctggttatcctgtatgctgtaatataccacaaccaagcacctttccagacagactttttttaagctgaatgattcaattttttaatgttttttggaaattcagaagcttctgaaaacattcacttgtggcaatttgaatttatctttcattttaaactcctgaaattcagatttttacaagtccaatattgccctagggagaacatgaatttgctaagaaatgttatcttttaaatctctgatatctttgtcttgaagcagccttgatatgtagtaagcgtgattcactttagcctgattataatattatttatctaaagtttgtttatgcattgccttgtcccaggaattttttaagaggacttgcagagacacgtaccacacagtaacatttagactaaatatgctctgagtaaaggagaaatgaaaaaatattaaatcaagagtgaacatgtacacaaagtgcaattggaagtgggctacaaatttggcccccagcttcccagcaggcaactcaaagaggtaactgaggtaaaatgttccagctcagaagcattggatcttggataaaaagcctacatgatgcaaactgtggcaactgagatgtcagatctcaagatctcaaattgtacttgtgggagcacagtcagtgaccccagatgaccttgactgacctaaaagttgtgggggaagtcggatgtcagagccttaacaccagcaggtgaccatccaacctggggcaatgcctgcctgttcaccacttagcctctttctggcaagtcattagaatgtcctccatcttcattggctgcaacttgatgagctacagcctctttcctaacttcctttatgatgctagtttaggttggttataccagcttggaagtatgcttagattaagttacagcagatacacaaattagatgcaagtaaaaaaaatcagaatttctgtagtagaaactacgaaaaataaaaaggaaagtttttactttttgggtatttttttacgaataagaaaaagtgagcgttaatcagttcaaaaggaggtactgctgtgtaatgggctttgtacgttccttctcatgtcacttacgtcactacttcgccatcaaattgaacaagcttttaattagatcctgaaaattcactatgctagtagtttattggtagtattatattttgagtagaactctgattttccctagaggccaaattctttttatctgggttaatttcttttaaacataacaatgttaatgctgaattgtatattaaatcccatttctaaaaaccacacaattttttctcatgtaagttgagtggaatgtggttagttaactgaatttggaatgttcatataaataatttgttgctgctcaatccggtttcccactgcctcctctctaccgcccagtataacctcgttaattcacctctcggacttggaaagaatgtctcataagtcttgggagataagagattcaggtatcccaagtaaggattctaacttcgaaaatgaatatgtcattgagttttacacgattcaagattcaaacgtgggcaacagaaatctctgttcttggaaacagatttatttcaggatgtgaaagcccagctgtgggtttcagagtttgcacacctgcatttcctcacccttcatctgtggccatgctcgtagatgcttttcttaggaaaatttgattaattgaactttttttgttctaaatgcaatctgaaatgagtagagactaacgctggctgtgcgtgcgtgtgtgagtgcatggtagtgaggggttggggagccttccagctgattttgtttcccttaagtactaatgaagaatttacttgaattgttctaacctgtacatgtattttctttgacctatcatttggacaatgttctgtggttaacatcttaaattttttttttttttttttgagacagggtctcactctgttgtccaggctgagtgcagtggcttagttagagcccactgcagcctcaaaactcctgggctcaagaaattctcccaccccagcctcctgcatagctgggagtactagtgtgtgccaccacggacagctatttttttattttttgtagaaacagggtctccctatgtttcccaggctggtctcaaactcctggtctcaagcgatcctcccacctcaacctcccaaagtgctgggattacaggtgtgagccactgtacccagcccatcttacttctttcagtgcatggaaatttacttccaggaccgcgagagctgagaagagcacggtattttccctttagccttctttggaccgtagctgaagtatgtgctgtaggtgaaagcacccacactgggcctgtaaagaactgcctttatttcaaaaggaggaaaaagtaattgaagccttaagtttgtgtaattggtatctgtatttcatcactcatttgagacttaaaagtaattaaagcctcataactagactgatgttttgtgttctcacattagctaaaccaaagaatctattgagtctcaacacagtacattaagttaagagagcacatttgtgccttcgagcagttaaatagaggagaaacccatgaacagagatgaaaccccaatttacagagaaatgaaactccatgtcatctgacctattgccactacttaaaggggctttgtaattgtgagtcaccatttcagggcaggccattatgacaaatcagacagatgcataagggaaaggtccatggctgggtgcagtggctcacgcctgtaatcccagcagtttgggaggccgaggcgggcggatcacgaggtcaggagttcgagactagcctcgccaacatggtgaaaccccttctctactaaaaatacaaaaattagctgggcatggtggtgcgcgcctgtaatctgagctacttcggaggctgaggcaggagaatggcttgaacccaggaggtggaggttgcagtgagctgagatcgtgccactgcactccagcctgggtaacacagcaagactccgtctcaaaaaaaaaaaaaaaagatccagacacaaccaaccgtttgatcctcgcatgagttcttctgagttgcccaatcccctcccaaacagattagtgatagtcagtcctagccccactgaatggccctatgcgaaggaaaacgggaaggacgccatagcgagaaagttctggactgcagtcgagtcttcacagtggttgggtgaccccagacaagtcattcgctgtacagggttctcataggcatcaagagactgggtactggggatggtccttaaggtcctgtccagctgtgggaggtcttaagtgccaaaagaaaccaaattgactttttattccactgacaccagacccttta

SEQ ID NO: 79 - DNA, 2363 bp, Homo sapiens
ctacaatctgtggcctcagcccttgccaactctgcctcttcccccgctgactggggtatcagtttatggtgccctgcaggaagaccctcttgttcctgtgggtgggaaggttctggaatctcagttgccctctctggagttggggagacataggcttttggaggacaagctttgcagagtggttcatggagtgaggtggtgggagatttctgaggtgcggtgcggtgaatggagcaaatcagaaccaccccttggacgttgatctcaagcttggctccagaactggcttttgaaggtggagcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaacggctttagctgtttgtgtgtctgtccagcccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttgcccaaaaaaaaaaaaaaaaaaaaaaaaaaaaaaaaaaaaaaaaaaaaaaaaaaaaaaaaaaa

SEQ ID NO: 80 - DNA, 1100 bp, Homo sapiens
ggagacgcgggggcgccggcggccgttgggccgcgcaagtactgtcaaggacagttttcgggacgggggacgcggctccaggcacccaacagcactgacggcgaacacttcacgggcgcgcgatgcctcgacaaggcggccgccaccaccacctcagctgccctcgcgggcagcacggcgcggcaaaagcgcacgtcgcctagcgatggcgcggggcggggacacgggctgtaccggcccgtcggagacttccgcttccggggccgccgccatcgctctcccgggcttagaaggcccggctactgacgcgcagtgccagaccttacccctcacggtccttaagtctcggtcgccctcgcctcgcagcctgccacccgcgctcagctgcccgcctcctcagccagccatgctggagcatctgagctcgctgcccacgcagatggattacaagggccagaagctagctgaacagatgtttcagggaattattcttttttctgcaatagttggatttatctacgggtacgtggctgaacagttcgggtggactgtctatatagttatggccggatttgctttttcatgtttgctgacacttcctccatggcccatctatcgccggcatcctctcaagtggttacctgttcaagaatcaagcacagacgacaagaaaccaggggaaagaaaaattaagaggcatgctaaaaataattgaggttttcatgattcagcacctgcttttgtttctgtgagatgagctaaattgctttcataccccagataagagctaaaaccacctaatgctcttatggcacagctgtgtatagatttagttctctttatacttcatttctagcccagttgggttttgatttatataagtagtttagaccttctcttcataatcttgctctgagatggggaacagaacacacaagtatgaagtttctttcaggtgtaaataatgaaaaataaatgcctcataaatgatagtacaatgtaactatcaaagttttataattcattatgagttaaccattttaatgtttccaattaaacctcatagtgcaagttctttgtctaaaaaaaaaaaaaaaaaa

SEQ ID NO: 81 - DNA, 2731 bp, Homo sapiens
agacaagtcggaggggagggagacgcagaggcggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtgaaaaaaatggagtcatagttttgatggagagaacagagaaacaagtgttaacatctttctactataggtttttttcatttttaggctattttacttgtcaaaggcccctgagaacctgtagctaaggaactcttagctttccagtgataataacaataataacaacattctgtacttactttgtgccagaaatgctccaagtactttacatgtgttaataatgctcacagcaatcctaagaggcaggtgctgttattatccccattttacacatgaggaaactgagatacaaaagttaaataattgtcacacagctagtgatagaactgggattcaaacctggggagtccggcttcagagtttgtggtcctgcagagacaaaacagccgcttttccagtattttcccagtatggtcagagaagacctgggtgcttgccaagatcctttgacctttaggaatatttccctacagccttacaaaacatcaattttggctgagcctagtacccaacactatattcagtttgtaagaaattaccattatcacatttcctgtttgtcttggagaggttgtcctatctcgcaccacatggtagggaattgtgaacaacactggacagaaagttaaagccttggattctgtactcttcattcctgtaaaccttgggtaagtttcggaattctctgtgagcttcttaaagtttttgaaagcatgtaaccggataagtgtatttttacaatggaggagttacagtcatcttggtatttgtgggagattggttccaggatccccaagcataccaaaatccaaggatgctcaagtcccttatataaaatggtatagcatttgcatataacctacacacatcctcccatatacttttaatcacctctggattacctataatacctaatataatgtaaatgctatgtaaatagttatactgcattggttttttaatttatattttttgttattttttaaaatatatttttaatccatggttggttaaatctgtagatatagagggccaactgtactgttagacacaagggtctcgaggcttgcagatagagactgaataaccctctccatgatgatcccttagagttcccccactgtgcctttttctttacatgtgcatgcaaacatgtgtctccacatacattttttttaacaaaaattgaattatgttgatatatgtcctgtaatttgtgttttaaacttaatatatcttaggcattttccctgtgtgtgtgtataatgcagctattaaaaatgagtctgaggccaggaaaaaaaaaaaaaaaaaaaaaaa

SEQ ID NO: 82 - DNA, 1466 bp, Homo sapiens
cgcctcctgcctggtctcgggtgccagcgccgccggcggagaacaggagcatggagggcgggctggggcgtgctgtgtgcttgctgaccggggcctcccgcggcttcggccggacgctggccccgctcctggcctcgctgctgtcgcccggctccgtgcttgtccttagcgcccgcaacgacgaggcactgcgccagctggaggccgagctgggcgccgagcggtctggcctgcgcgtggtgcgggtgcccgccgacctgggcgccgaggccggcttgcagcagctgctcggcgccctgcgcgagctcccccggcccaaggggctgcagcgactgctgcttatcaacaacgcgggctctcttggggatgtgtccaaaggcttcgtggacctgagtgactccactcaagtgaacaactactgggcactgaacttgacctccatgctctgcctgacttccagcgtcctgaaggccttcccggacagtcctggcctcaacagaaccgtggttaacatctcgtccctctgtgccctgcaacctttcaaaggctgggcgctgtactgtgcaggaaaggctgctcgtgatatgctgttccaggtcctggcgctggaggaacctaatgtgagggtgctgaactatgccccaggtcctctggacacagacatgcagcagttggcccgggagacctccgtggacccagacatgcgaaaagggctgcaggagctgaaggcaaaggggaagctggtggattgcaaggtgtcagcccagaaactgctgagcttactggaaaaggacgagttcaagtctggagcccacgtggacttctatgacaaataagcccatgtttttggcttcctgaacctttttgcccccacttttagacataccccagagccctgtggctccccacaccctgccataggggcagtcctgccttacacatagaagcattcatgcctgctgccctgccctcaggcacagccagctgtgagctcccaggtcattggccttaccagttgtcaggagtctgtgctgtgcaccctgggttataaggaggcttaggagagaggttatgggtattggtgtctctatccccaggaatagaacttaaggggtgggaagaacaggaaaagaagctggaacacagaagagaggaggttgtgtctcttgctcatagcaagcctgtgggtagaggaaagagtgatctggtgtcgaataggaggacccatgtagattcgcagatggcctggatgggaggaagggcagacggtacatgtcccagcccacatagatgccccttgctgagggtagcaggaccttctgttgaactttgtgtcctcactctgatgtctccttccttcagaatctaccacccctcccccaggctgggagaaggggctcctgggtgtctgtatacacgccaaaggcagatacaaataaaatacagattgtcctttcttaaaaaaa

SEQ ID NO: 83 - DNA, 108473 bp, Homo sapiens
ggtgcagtggcttacgcctgtaatcccagcactttgggaggccaaggttggggattgcctgagctctggagtttgagaccagcctgggcaacacggtgaaaccctgtctctactaaaatacaaaaaaaaaaaaaaattagccaggtggggcagcgtgcacctgttgtcccagctactcaggaggctgaggcaggagaattgcttgaacccaggaggcagaggttgcagtgagccaggataacaccactgcactccagcctgcaccactgcactccagcctgggcaacagagcgagactccgtctcaaacaaaaacaaaagcaaaaacaaaaacaaaaaacaacaacaaaaaaactatcttgaaagtagccaaagaggagtgccacattacctttagtgggaaaacaatgtgaatgataacagatttctcactgaaaccatgtaggtcagagagaaatggcacacttttcaagtactgaaagaaaataacagttggcccagaattctatattcaatgaaaatatccttcaagaatgaaggggaaagggattgcagttttaaaatttgggaaacagtgaccaaaatctgagagcttctctttggaacatcaagggcaagcagcaagaccaggagatgtagtttgggggagcaagaaggacatataggattagagactcttctttggaagactgatctaaaggtttaggaagtacttggagaagaaggaaatgttggggtgtcctgatgagttggtttgtgaaccccaagtatacaaagacatccttatgaggcagaatgtctcaaggacttagaggttatctcccaggagccagtcatgggcaaatcttttctttgaaatatacggagtttatacatcgcaagcctgcttagttaaccccgtattgcacatacagcaaccaaatgcaatgtgtggaccttgtttgaattttgattcaaacaaaccactgtaaacaaaacaaaacaaaaaaatgaccttttccttttttcatttaacagtttattaaggtatagtaaacatataacacattgcatatatttaaattgtacagtttgataagttttgatatatgcatatacttgtgacatgatcaccacaatcaaaataatgaatgtatacagacatcactcccaagagtttcttcttgttccactttaatccctccacctggctcttctatgtcctccctatccccaagcaaccacttatcttctttctgttaccaaatttgtatttttcagaattttatgtaaatggaattatgtagtgtgtactctatgtcggccttctttcattcggcataattattttgagtttgtctatgttgttgctgtatctataatgtatttctttttattgctgaatagtatttcattgtattgatatacctcaatttgtttatacttcaatatgtccatcttgtgttggtgggcatttggtttgtttccagtttggggatattacaaattaaggtgctacaaatatttacatacaagtcattgtatggacatacgcttttgtttctcttgggtaaatgcctgggatggaattgctgtttcatatagtaggtatatgcttaagtttttaactaaaatggatgataggccaaaaggtaaaatctaacactatctagatgaagacatagaagaaaacctttttggccttgggataggcaaatatttcttagatatgactgcaaaacataattcatgtaagaaaaaaatgacaaattaaatgtcctctaaagtaagaaacatgctctttgaaatacagttaagagaatgaaaaagcaagccacagactgggtgaatatttttgcctgtcacatatctgataaaagacatgtccggcctggtgcagtggcctacacctgtaattccagcactttgggaggctgaggcgagcagatcacgaggtcaggagttcaagaccagcctggccaacatggtgaaaccccgtcactactaaaactacaaaaattagctgggcgtggtggcatatgcctgtaatcccagctactcgggaggctgaggcaggagaactgcttgaacccgggaggcagaggttgcagtgagctgcgatcgcaccactgcactccagcctcggtgacagagtgagattccatctcaaaaaaaaaaaaaaaaatacatgtccagaatatataaatatttctcaaaagttaataagaaaacaaaaacaaaatttttaaaatgcaccaaagatgtgaataaaaacagaagacagacgatatatgaatggaaaataatcacatgaaaagatgcccaacatcattaatcattaggataatgcaagttaagacacactgagatactgctaagcaccaattactatgtttaagattaaaaacattacaataccaattactggcaaagaggtagaacaactggaactcccataaactgatgggaatataaagtggtacaaccactttggaaaacactttgacagtttcttattttttttgctttgaactttgactttaaaataatttccaacttacataaaattttcaagtcactcaaagagctctcatatatccttcacctaaattctccaatgttcaacattctacatttgatttagcatcatctctcttctttttcctgaatcatttgggagctaactgcatatttaatacgtcactgcccccttaatgctgcatttggtataatactgccatgtaatccacagattcctttcaaattttgctgtttgttttaattatatcttttataggtccagcgtccagtatagattctaattttacacaatggaaatatttgaacatagattaggtattaaacgatgctaagaaattgttaatttttttttaagagacaaggtcttactctgttgcccagattggagtgcagtggtgcaatcacagctcactgcagccttggactcctgggctcaagcaatcctcccactcagcctcctgagggtgggactacatgtcacctcgtccagctaattttttattttattttttgtagagatggggcctcgctatgttgcccaggctggtctcaaactcctggcctcaagtgatcctccaccttgtgctgggattacaggtgtgagccactgtccctggccaaagggttacatttttagggtataagattagtaatatgttatgttggttccttttctagttagagatatatccttaggtatttattttttaaaatgatatgattgagacttaaaaaaaacactcctgagggatggagagaagagatgaaataaaattgacaaaatatctatggttgttgaagctggatgatgagtacagaggagtttacttctaagtatgtttgacattttcataaatataggtttaaaagaatttttttaaagaccaatagagaaatggagtaattttaaggattagagtgcaatggccatatttgcaatttagaaacattactctggctgcaataggaagaatggcttaatgtggggcaagaatgaagacagtgactaattaagagagttattgaagtaacccagggaattggtgacagtagcctgaactaagttagtggcaatgggttagagtgtagtggatggacagaagtggtgactatttggatgtgagttgagagaaagggaattcagaatcacactcagttgaatggtgccatttacctagtcagagatcactggagaaggaacgggtctccagcagagggaagatgatgatttaaattggccttgggtcaagctagtgcatttgtgttatctggccagaaatgagtggatagatggcagcaaggaatttacacaatcattatttagtgaacagtggaggagtaagcaaggtagacagaagaaacgtcacttaaacctaacttgggttagtacaataggattattcgaaatggacatgcagcattagtaagttactgaagatgaagtgcaataacaatgtctgggtagacaggttattattttataaacttgaaaaacgacgacttgaggcaggatataacacaaagactccctaaattcacactgagtgaactgggaagggaacatgattctcttcatgggaaggtagctcataaagatgcctgagtggaaagacagttttcaattgaatttgcaaggtggtagtggagatccccaaagctggggaatgtagagacagagaacataatgagggtgttgaatctgtggctcagagaataagtttgggggtactaaagtgggaggaaggagggtggggggggtcacaatttttactcccggtagtcttgttctgggaaggtacaaggtgaaattagaagtgacctcagaacccatcgacgtctgccctttaagagtttcccggccgggcgcggtggctcatgcctgtaatcccagcactttggaaggccgaggcgggcggatcacaaggtcaggagatcgagaacatcttggccaacatggtgaaacaccatctctactaaaaatagaaaaattagccgggcgtggtggtgcgcgcctgtagtcccagctactctggaggctgacgcaggagaatcgcgtgaacccggcaggcggaagttgcagtgagccgagatcgcgccactgcactccagcctggggaacaagagccgaaactctgccaaaaaaaagaaaaaagagtttcccgcactagccatgccagggtggagaagttccagcaagcacttctgttaaagatacttgtttcgtgaaaactatacaatgtggcgttttcattcctatctgtgattcatttcttaagttcgtggagttcctttgctccccttcccccagcaggatgtgggcaaagctgtccccctgccttcttccttcgcctgggcttctggagcctccggagctagctcccggcgcggagctccgcctacggcccgtccccggcgcggaaccccgcccacgagcccgtttccagcgtggaacaccgcccatagcccgtccccagcgcggagccccgccccgcaggctgccgggggcccaccgccgcccaggcaaggccgccctgccttgggcgcagcgctgccatggctgggggccgtggggcccccgggcgcggccgggacgagcctccggagagctacccgcaacgacaggaccacgagctacaggccctggaggccatttacggcgcggacttccaagacctgcggccggacgcttgcggaccggtaggaacgtggcttgtcaggcccgggctggcgtgccctggcctccccgggccctgggccaaagcccggacacttccagattgggccgccgctttaggatcctgcagtcttttcatcccttaggttccacccatgctcactttagtccttgcacctgcagctggtctgcagaatcccacctaggccgaattcttctacagtcctttccccatgatttccccagaggaatccccctggattcctccctcttacctggcactgcttcttattcctgcctacatcccataacataactgcctccttccaaccttgtcctttttcccctctgaaagcccttgcggatgataccacagcaattcatacgcgccccttgctactttgttctgagaacgctttttgggctctcgcacaggccttacgtcctcaatcagaattctcaagtctcatccatgcattcaaatctgcacgccacataattccctctgtactccccaggcatcctcactgtgttttccggtatggaggaactttccatacctctgcaccttcctctaagacatttagctcagaataaagcacacattcatcttagctgtagtagagagagggttctagactgagtctagagaaggagtgtccaatcttttggcttccctgggccacacacaaaatacactaacactaaggatagctgatgacctaaaagaaaaaaaaaattcgcaaaaaaacctcaatgttttaagaaagtttacgaatgcgtgttgggccacattcaaagcggcccatgggcctcgggttagaccagcttgctctagctctagaccttttaaaatggcattttgtttaaaataatattttgcctttttgtctggaaattaaggcacgttataaagtatttatactgacagttttttccccatccttgaagagttgatctaccaaactatttctgaatattatcatattatcatttaaaacatagttctaacttcatctgctttttttttttttctttttgagacagggtcttgctctgtctcccaagctggagtgcagaggcatgaccacggctcactgcagcttattctcaagcaatccttctgcctcagcctgtcaagtacctgggactacaggcacatgccactacacctggttaatttttttaattttttgtagagacagagtcttgctctgttgcccgggctggtatcaagttcctgagctcatgcaatcctctcaccttggcctctgaaagtgctgggattacaggtgtgggccaccgcgcctggcctcttcatctgcttttaactttggcatttcacaacatctgctctatctacacatccaggatttcctcaagaaataccatcttctggagctatcaggacaaaatattctctctcaaactcagggtgcttcttccttcattaaatatttgttttaggcattaggaatacagctgtgggcaaaacagacaaaaatccttgccctcagggagcttacttttctaatgcttaataatatgaagttatttttaacctgaaatggtaaaaatataaattattccccttaacatgacagagaagttggtgactggggaacttctatcttcccaaaccttgagaatcaggaagtaggcccaagaagcagccaaaataggtgtctcaaagtgtacatgggactcaacacaaagctcctaaggcttcattctgaactagtttgtttactttatacaagcttagttgtctgctcctagggctgcagaaaaatggaagagaaaaagcaacttcttttaggtagggatattgataacctcaagaatttatagctggtggctttcataacaagatggaatactagacaaaccaaagcaaaaactatagaaggcaggcagaagaatttaaatagctgtctgtggcctattgtacaccgggcaaatggcctcaacacattcataggactggcaggcaaataattgatggtctcaaggatgaatcagagtttagtcattcaacaagcacttattatcacctgctatttgccagggaaaagtgatgcaggtccaaaatcctttatccaaaactctttattgagagggagtttctctctgtcgcccgggctggagtgcggtggagcaatctcggctcactgcaacctccacctcccaggttcaagcgattcttgtgcctcagcctcctgagcagctgggattacaggtacccgcctccacacctggctaatttttgtatttttagtagagatggagtttcattatgttggccaggctggtctcgaattcctgacctcaagtcctcccgcctcgcctcccaaagtcctgggattacaggtgtgagccaccgtgcccagccttttatccaaaactcttgagacttgatgggtttcagaattcagaagtgcttctgttcacgtttatgtgtgcacattccacacattacctaataccttcctcagtgtctggggcagcatcgaaaatcaaacacaatgaaacatagaaatactcaaatttcacactgaacaaataaacactataactaacctcatgtcagttcaggctaaatttgctgccaataaattcaggttagatttttttttcaacttcttttagtggggatgtgttgtaatataaatttcagtttagtagcatatgtatatcatttataaataacattttgaggtgcatgctaaaaacttttgcatttgtaaaaagtttagacactgctagtttaaagtatctataatttatagatagttacaaattactaacttattttggctagctttccacagcagcaaaaggtctgctcatttataatttgatagcttttggaaacatccctccaaaaaacttgcttcaatccctggatcccccagtagtgtatggtggtgtttgttttcctttatcttcaacaatactatatatgttagactttttcatctttgccacataaatgaaacatatctcattttaatttttatttatttataaattatctagaacacctttgtttacaaaccattgatttttctttttctgtgaactgctcatactctggtttatttttctactctgtggtccattttcttgtttatttgtaagagctaaatatcttaagaaaactagcattttgggtcatataatgcatatatttttctcctaattatatgcatttatttacgtaatttatgtgatttaaaaaatgttgatagagtcaaaatgaccttttttttcttttatggtccctgtgggttttttttccccctctgttccaatgttactaaaaaccaaattcgtcaaagtttacttttaacttgttcatgacttcgtttttaaattttcatcaaataaagatataagtaggtttttttttttaagttcttcgttccatcaaagtacgggcctaggccacctccccgtgtgcatccctcctcctccagctaggcagctagacaaatataggcaattgaatttttcagtgtcttccactcatttgaaatgccattcctacaagcccagtgcctggtaaaacaaacaaaaaactttcaaaaattgttactgaatgaaataattctcaaatgtatttcaagtctctttttttccttgcctggaatgcttggtctcttggcttgtctcagcttcaatgctacatcctcagatagttcttctttgataaccacatttaagtatataccctcacaccccaagtcgtttgttaaggagagcaccacgtcatctcttcaacggcactctctaagcttgtacttatgtgtttattatgtttgttttcccccaccagactgaagttccatgagagctggaaccatatctgtgttctcacctccgtggactaagcacagtgcctgacacagagtcagtgcttagcaaatatgggtgatggatgtgtgatgggtgaatgagtggatgaaagacctgtggaccaaagagtgcttaacccttccccagaccacattcgcagaattatgctttatggaaggacccacacatttatcaaggattattataaagccatataagaactgatcttacaaattttgtacacatagtagaagagtacagtgtttattatatggtactccttgtaaggttcacgttataaatttctgttagaatttagtattataagtactttgcttccctaaaataatttttaggctttctcttttctgatgataccacgtttctctttttgccctgcctgccaggacattcagagaaaaaaatcaaggctcaatcccagcaacttaggatggcataataaaagagtggcttatgggaggagacagggtttggagttaaggctgggtttgaatcccagctctgtccctgtgtatctgtaggcaagaatgtaaaactccctgagcctgagcttctgtatctgtaaaatggagatgacacctgccttgcaaagttggtaaggtgcctggaccatgggagcgctcagccattgttttttctctcagactccccttgttcattatatacatataatatgaactacttcaaatccactttggaaaaagtgtatctaaattgaagaacaagggtattttgcgatttggtgaaaagtagttgattgaaaacatatgcaattctctccttgtcaagggttttcatttgttaatatctcagtattcagatctcaattcaaatctcccctgctcgcagagtccttcactgacctacctgtccagataccttctcctcgcccaccactatgtccctctactctgctttgttttctttacagcactcatcactatttgaaatcactcgtcttctagtttgtatcagctggttgggactgtgtctgtctaaatttacccctgcactcccagcttccaggagagcacccaggcataataactcagtaacatctgaacgaatggaagctgagtggaacattttggttcattccttagataacttaaaaaaggaaagtgcattttcactggcttaggttttgtttttaaatcatgcttttggaaagtatgccagattatctatttaaaatataattacaaatatttttaaagtagaacttttgatctaaaatgatcattatcttaatcattaatgattggctctacagctttgaaaaaaattttttttgtttttcctcttttaggtcaaagagccccctgaaatcaatttagttttgtaccctcaaggcctaactggtgaagaagtatatgtaaaagtggatttgagggttaaatgcccacctacctatccagatgtgtgagtacatttataaatagctttgacgtggtttcagttttctgttttgacaacatagaaacagattgaaattcgtagtattttctccttcctgctcccattccacataaaatttcatttcctctatttcaacaaaactacatcagcaatagatgttttcatgaaacctgtctcattttaagcctgttcatagttatagaattgtcactacagatacttatatttgcctagtgactattttgcttcctctgatgtgttaacttttgtttatttatttcttcataagttaggaagaggaaaatttggaagaaaacaataaaggcatggtgactgttgaaagcccttgcatagttagagtgtggctggtattagaaattcagcaagtctgtgcctcagatgacctttcactgcctagagtgagggagagtatttggatctgtcctgcctctcaatggggcactctggcgagtgtccattgtgcagggctgtgctgtgcactgcagtacgtttagcatccctggcccccacctaccaatgccacgagtgtcctccaggcattgaaacaaccaaataacctacatatttccagactccctctgaaggtgatgtcacctctggttgagaaaaactagttagagccaaagtgttagccatcagcacttaagcatgtctatttggtgtaatctttccccacccatcccacatggaaaggcaggttggcctggatggcgttaagtagtttgaaattattgtatggggaaccagtgaaggtttttgagatggaaagggacaagtaaaaggaaactctgctttacacagtgggtggtaaatttatggaatttattatcctaagaagtgatagggaggatatgaaaagacagataagtcaaaattgagctccttgaagtcagtaaccattcttggcccccaaaactgtcctgagagtattatagtaggtatactatacatactataaaaatattaattaacgaaacgttaattataaaacattaatgaaaaagataattaaaaatttatgaaaggaaattaaaagagtgcctctctaggttgtttttttttcctgacaccaaatacatgatgccttttctgataccatgtgggtgtccagtagttcagttcaattctgacactatctgtagttagcaaagaccccacagattaaggacccagttccacaagattgcctccatttctgatgctagtggcaagtcccagtacttctgaccatttatagccagtatttataactggctataaatttaggggtttccaccaccccctcctaagttgcgataattgctagaatgcatcacagaactcagtttctgtgagttacatttaccagtttgttgtaaaggatatggctctggaatagccacatggaagtattatgaagggtaaggtgtgtgggaagaggcacagagctcccataccctctccaggcctggcaccctcccagcacctccctgtgttcttcaaccaagaatctccctgaaccctgtcgtttaggggtttttatggaggtttcattatgtagagatgattgattaattaaatctttggccactggtgattgaacttgatcttcagccccctactcctccctaaagatctgggatggggctgaaatttctcaccctgtaatcaaggcttggtttttctggtgaccagtcctgatcctgaagctatccaggtactgaccagagttccctcatgagtactaactccggtatggttggaaggggtttgttatgaaaaacataagatgctcctctcacccctgttgctcaggaaattccaagggtgataggatctctgtgccaggaacaggggtcaaatatcaaatatatatttttttattataccatagcctcaagaattcaaagtgtttattcttgaaaaatcaaaataaagaaaaaggtataagtgctataatgttatataagtgctaaaatattaattatagcattatttgtgaaagcaaagatattggaagcaatctaaatgtcaaatactagagtgaggtttctccaccttggcactactgacatgtgggcagataactctttgttgtggggtccttcctgggcattgtgggatatttagtagcatccctgacctctgtctgctagatgtcgggagtacatttctccccaggttgtggcaaccaaaaaaagtctccagatgttggcagatatcccctggggccaaaatcacccctggttaagaatcatggcactagataactattcaggtaaatcttaatgtgtccacttgataaaaatattatgggatgattgcttttaacatggaaatgcttataaaagttaaaaagcaaacattataatatcagctacataaactatgaattatatagcaaggaaataaagagaacattagaattttttttgaagtttaattagcatcattgatgattttttctccattctgttaatattgctatattatgattacttattttttaaattataacaaaaatcttaatttggggtaatattcttatccttttgaatgtggtacaggaaaacattgcttttctgcagaatagtcctgggtgccactgtgagagagagactcccgggttagattctggaattctggaaatttcagccccatcccagacctttggggaggaattctagaaatttcagccccatcccagctctttggggaggaatctaacccaggattccatacatagagtcaggactgtatggtttgtttttctgttctttccctcatatagactactttctctcagatttctatctatagaaatagataatgatcatagcaccctttcatactgaagcattgagagaacgcatagataagtgcatactcaagacttcactggttaaatgccatgaattactcagaaatgcttggtaaaaagtgatgagtcatcatctcttcagtaaaattaaataactcctatttaatctgagagagttgttattggatatttattggttgggaataaaatgaaacccgagggctggttgtgtaatgtccttgagttgaaagtgttgacttagatgagctctaggcagaggtgcagagagtgtgcatgactagatgtatttatacacaagaagtgagcatttccacctggtttcgatcagaatgagtgattgggatgcagcagtgtgttgtgggaatactagagggatcaccagggctccactcatctatttattcttgttctgctttatgctagagcacacctgaatgcagagcgcttggccttgccagtgagctgtcagagctaggttaattctcattggctgcaagctagggtagagaattaccatacaaaggagcacatggttaagttactgggctagagtcagctgcagaactggaatgatttttttttttttttaaggtgaagaactcagagttagggatccaggtcaaatcgtaggaaataaatagtaattgatgttgggaaattttaatcagattgtaaagctgaaattagatacaggggtcaagcccagtaagtctaacagcccagacagaaggctttggccagcccacttcttccctgtaggacgcaggtgactccactgtcaactggagttgcagggatatggttgaagtccctttgagattaagggccttgggcccagagtgctttcagtttagcaaatattaatgcaaacaggctatactttctggagtaactcttttttttttttttttttttgccttttccagagttcctgaaatagagttaaaaaatgccaaaggtctatcaaatgaaagtgtcaatttgttaaaatctcgcctagaagaactggccaagaaacactgtggggaggtaagatttgttaaactggaattaaaagaagacagtaaacttccccattacacctcaaatccaattttgagtagcatgttttgtgttttattggttctacaaaagggaacattgtgatttttatttatttaataggattaatgaaatttgtagtctatagatggtactattgatgctgaagaatgtttctgaaaattgctaggcatggtggctcacacttgtaattccagcacttggggaggctgaggtgggaggatcacttgagcccagaagtttgagaccagcctgagcaaaatggcgagcacctatctctaaaaaaattaactgggtgtggtggtgtatgcctatagtgcaagctgctcaggaggctgaggtgggagaattgcgtgagcccaggagtttgaggttacagtgagctatgatcacaccccttcactccagcctgggccatagagcaagaccctctctcttaaaaaaaaagaaaaaaagaagaagaatttttctgaaaacagttgatgtgaacccagccatactttttgtatactttggatcttgcatcatgacttgaacctttttgttggaaaatgtgggcagacaaacaatttcggaccacctctcccctttgcatatcagaggaatttgttgttttctttctcaataattagtgacacactctactccttcagtgtctgtcatatacctgagcatttacactgagtgcagtactcattcttttttaatcttctgaacattaggatctacatatgagttctctcctgggtggcacaactctctgtggaaggcaagactaagtgtcttctggaggcagagtatgactgtgctttccttaggccagaccaattccctcgaagtataacgcttctttgccccacttttgtgtaaaatcactcagtgtttttgcctggcagcttatgtttaacgatctctttttttttttttttttgaggcggagtcttgctctgtcacccaggctagagtgcaatggcgcaatctcggctcactgcaagctccgcctcccgggttcgcgccattctcctgcctcagcctcccgagtagctgggactacaggcacccaccaccatgcccggctaattttttttgtatttttagtagagacggggtttcaccgtgttagccaggatggtctcaatctcctgacctcgtggtccacccgcctcggcctcccaaagtgctgggattacaggcgtgagccaccgcacccggccaacgatctctttatgtgaaaactaagaagaggtgccctcggcttccatgtctgtttcagacttttattagacataaccaaagataaccattcatctcatggaaagtaactggacagatttttacttgcttttcataacacaatgagtcatagtacagtccatggaatgccttttagttgtaaaaattgtgtccatttaagttgctgcttccaagaacttcagtgattgatgagatttagaaagtgagtgtagaacggcctggataaaaaactaggccttggaaatgattccaaagttctttctagtacaaggggattccagtgtctaactgaaaagtaatgtgaagttatttggaaaattcagctccagagaaacctctggtttcttggatttttgatttgtgatttaaattttttttttttttctttttgagagacgaagtctcaccatcttgcccaggctggtcccaaactcctggctcaagcaatcttccttcctcagcctcccaaagtgctaggattacaggcccgagccaccacacccagcctgatttaaatttttattttgagataattatatatttatatatacctcttacccagtttgccccgacagtaacagtttgctggaaagaagatcaaattagccaccacattcctttacgccaaagcataatctggatcaaggccctaactctcttcaattctgtgaatgctgagaagagatgagggagctgcagaagaaaagttaaaaggtagcagagattggttcatgaggtttaaggaaagaagccatcttcataacataaaagtgcaaggtgaagcagcatgtgctcatgaggaagcttcagcaagttacccggaaaaacctaagataattgatgaaggtagctacagattttcagtgtagatgaaacagtcttatatggaagaaggtgccatctagaattttcacagctagagaggagaagtcagtgtgtggcttcaaagccttatgaaaggacagactgactcgcttgttaggagctaatacagctgctgacttttcaaaagttgaggccagtgttcacttaccatgcccaaagttccaggaccgttaagaattatgctaaatctcctttgcctgtgctctataaatggaaaggcaaatcctgtatgatggcacatctgttacagcagggtttactgagtattttaagatcattgttgagacctgctgctctgaaaaaaaagattccctttaaaatattattgctcattgacagcgcacctagtcacccaagaattctgaaggagatgtacaaggagattaatgttgttttcatgcctcttaacacaacatccattctgtagcccatggatgaaggagtaattttgactttcaagtgttattatttaagaaatacattttacaagcttattgctgccatagatagtgattcatttgatctgatgtgtcttagcaaagtaaatggaaaaccttctggaaaggattcaccattccagatgccattaaatacatgattcatggaagggggtcaaaacatcaacatgaacaggagtttggaatatgattctgaccctcatggatgactttgaggggttcaagacttcactggaagaagtaactgcagaagtgatggaaatatcaagaagtctattactagaattagaagtggagcttgaagatgtgactgaattgctgcaacctcatgataaaactttaacagatgattagttgcctcttatagattaggagagaaagtggtttcttgagtggttcctgaagatgctgtgaacattgttgaaatgacaatcgagcatttaggatatttcataaactttgttttgaagcagcagcagggttggagaggattgaccccaactttgaaagaagttcaagtgtgactcaaaggctatcaaacagcattgaatgctacagagaaatcttccatgaaaggaagagtcaatcgatgcagcaacttcattgttgtcttcttttaagaaattgccgcaaccaccccagccttcaccagccaccaccttgatcagtcagcagccatcatcaagacaaaaccctctgtctgcaaaaagattatgacgtcctgaaggttcagatgatcattagcattttttagcaataaagtattttaaaattaaggtatatacattgatttctacagacataatgctatttcacacttaatagactaccatatagtgtaaacataacttttatatgcactgggaaaccaaaaactttgtgtgactcgctttattgtgacatttgctttactgaagtggtctggaactgaacctgccatgtctcagagggccgcctgtgctagcattcatctgagtcatcgtcatataatgagatttgaatgggtgttaaacatgggaaggcactgtgcaaatcactcttcttgtttatctaaaattcatttccattaagtctggagtactggaaagtctaaaatagacataattctaaagaaatttttttattttcaagtaaaatagagtataattaggtactaaagcatggcatagggattcatcttggtatggcattcactgatacttgccttttaaaactaggagtcatttaattatttgaatggaaataagtactcaaaaacagcttgttcttaagcacttccaattgcttatgaatgatttttaatctatacacagctctttgtcatgtaaaaataaacttaagtatactctattttttcaaatttgtaaagccaaagtttatttttttattaatttactcaacagatatttattgtctgtgtaccatgtgtcaagtgctattccagcactgggaaaaccacagtgagcaaaccacaccatgggctacactgggaagggaacagacagaaagcaatcaaataactgcacaaccaatcaggcagttataagtgccatgaagaaaatcagggtgagcggtctagagagtgtgacagtggagtggctgttctttacaaggcattcaggagaggcctccaagacttaagcagaggtctgagggaggccagtgagccctgtagcaccaggggagtaggaggcaagagtcagtttggaaagtagttcttttcatccagtcttagaaggtttatcaggttgatttgtacagaaaactctagtaaagtaaatagaacagcaaaagaaaaaccctccacagcttggctcctgcctcctttttggtttagaagtggtttctctttgacatgatagaaattgcctactttccccagctttcattagaagagcttttcttagaataacctgcctcttagactgtagactagtgtttctgactgtaaagtgaaatatatccagtaaatgccacagcttctggtgtaagaaaaaatgcattaacatcacccagcaagagctgtgctttctttgcatttgctccctgagagaaaggcaggataccaaatgaactaactttatatttttgggtacaatgacttctattattatttaccaccctgttaagtccctttagaaacggtttcaaacatataatgaaaataagaattttaaaattgcttcactgtaactgagaaaaaaaatctcaatgttatgttcctcatccaccaaaggatcagcactctttacctctttggggttgggtaaccagtcagggagggtctcagaaatctttgttctattgatttatcaacctaagtatgatttatgtctcctgcgggtaagggaaaggggcttcctgtgttcacataaagaatgtgtgaaagggagacctttttcttccacattctatctgtgactgcttctctaagtggaaataaaatactttctaagtatttatcagctttttattgaccagttactaacaaggagataataaggcctttaaatatttgcctctgtactcccaacaatattttcagtatgctgggtagacagaaaaagctctgatcttagcaatgagtattctctgcccaactctcattatgtggacaggttttctagttgggaagatagcttttactttcatgcagtcttaaatgttttgtcagatttatttctaaagaaatatattttattggatttactatagagaaaatgccaataagttgaataggtctataaaagaaaagtgaagctttttatttacctaggtaatgatctgtcttgataataacacaatgcaatgggccctttaaaagctttttcctgctgtgattatatcatataccgaattcagagtatgtcatatcaaaatgaataatggcattctaagtgggcctctgaccgccagtttgctttcctgttctgtagcctctcctgtttgggccttcccattatttgatcatttgtggttgatttttgtttacatgtttaggtgatgatctttgaactggcttaccacgtgcagtcatttctcagcgagcataacaagccccctcccaagtcttttcatgaagaaatgctggaaaggcgggctcaggaggagcagcagaggctgttggaggccaagcggaaagaagagcaggaggtgagatgcccttgtcgatgtctgtgtgcatggccagcctggaggattgcaaactactgtaggttttatctgtctctgcctacaaacttatctttaagttttgctcagcctttgattcaagaaaggtagacacatgtgagagtatgaaaaatatgagtgattccctcctgacacatatcagtactgtcccttagagccctcagtccaggtcttaaagaaatagaagagaaaagaagctgtttaaccaaaccacctgtggtcttttggagcttgttagggtgtacaggagttcactgcattttagaagctattttcttcttccctgtgcaagactagtatctcatgcccaaatgagtagcaaaagccagagaataatttttttattcaaacatttagatgtatatattatctttgatttaaaggattttaaaaataagacagttaatatctacgcaaacagattaaagaaaaaatacaaagattaaataccatttgtatttaaatcaaagataatatatgcatctaaatggttaccatttgtattttataaactcctgtttatatcctatgctgagattctaaagatttgtttaaattcaagtttgtttaaatacaaatagttaccatttgtatttttctttaatctgtttgcataaagatataaactcttgtcttatttttaaaatcttttaaatcaaagataatatatgcaactaaattcccttttttattttaatttatttttctaaagttttaaattttttatttgttttttctatttagcactttaatcaacttatctagaacttactttgattcaggttataaaaaaagcctaagtatatttttcttagacattttcctaacacatttattaaataataattcttgaagtgattcataatactttctttaaactatatgtttaaaaatagtttaatgtattttaatattaacagcaaacgtgcaagaagtgcacagaagacagataacattaaaaacatgtacttgcatgtaggacaactcagttagaaaagtatactgaggccagttgtggtgtcttgtgcctgcaatcccaggactttgggatgaggcaggtggatcacttgaggccaggagttcgagaccagcctggccaacatggcgaaactctgtctactaaaaatacaaaaattagccgggtgtggtggcaggcacctgtaatcccagccactcaggagtctgaggcacgagaattgctcgaacccgggaggaggaggttgcagtgagccaagatcgtgccattgcactccagcctgggcgacaactagactctgtcttcaaaaaaaaaaaaaaaaagaaaagaaaagaaaaatatagtgaatgggtgtaatctactgtatgataagaatgctacaaaccgtttagttgccatcaataaaaaatgtacttattttgatccttctatatagttcataagcttgatgatcggtgttcacacacatgtgagatacgccacctgtgaaccttgttaggacatcagcacattacccatctgacatgaaagcagaagaaagaaagagaagaatttacttgtttttaaaaaaatccaaatactggcattatccagaaaaatgtaacaggtttatctataattattagaaagttaaactgccgaaacttgttcactgaaacattttgatttgcattaatgctttacatcccccccatttatattaaaaattcacacatgaatgaaaatagaaaaacggccaatacgtgatttctgtcccctctttttccactcacagtcatatatgtaggtaccttttgaccccataggaaaaaaatatttaacattcagaagtatcaggaataataagagaattttttgcggggggagtgaaatttcccatcatagtggattctttttgtttctttgtttgtttgtttgtttttgagacagactttcgctgttgttgccccaggctggagtgcaatgatgtgacctcagctcactgcaacctctgcctcccgggttcaattgattctcctgtctcagcctcccaagtagctgggattacaggcttgagccaccacgcccgacccacagtggattcttaagcacgctctccatgtatgtgtcatgctagctggatatctttcagcacaattgttacatgtttggcatggatagatagcatacaggttggtgttttcaaaaaggccaaccagataggcctcacttgccttctgcaaagcaccaatagctgcactctggaagcacagatctgttttaaaatcctgagcaatttctctcaccagatgctggaggggagtttgcaaatcagttcagtggacttgtggtaacgtctaatttcacagaatgccacagtaccaggcctgaaatgatcggtttcttcactcctccagtagaaggtgcagtcttgcaagcggctttctgtagccagtggcttcaacccaggaggcagaggttgcagtgagccaagagctttaccacctgtggatttgtgggcagtctcctttgtattatacaagccatggtatagagacctccttacttacccccttctccttctgctggagttataggtggtgcagcggcggctgcaaacgcaattctcaagtgcatcttaactgcttacctatactacgttctatttgtcaatgatctgttcaactcatctgttttttcttgaatctctaccacactctttgaattattgtatctttataatgctttaatatctgacaagtcaatcctacccctccccatcccttcatcttccattgtttttgtttctcagccattctcacccatttattcttacagaagatgtacagaattactttcccatagtcaaaacaaaacaaacatcctgggatttttattgattttaaaaaatcttacatatttatttaggaagaattgatatcttcacagtatttagacttcccattcaggattgtttctttttccatccagggctgtttgtttttgttttctgttttttggattttttttcttttttttttttttgagacagcatcgtgctctgtcgcccaggctggagtgcagtggcgcaatcttagctcaccgcagctcaagggatcctcccgcctaagctgcctgagtagctgggactatagccgtacaccactgcacctgcctaattttaaaatttttttgtagagacaagatctccctatgttgccaggctggtcttcaactcctgggctcaaccaatcctctggcctcaacctctcaaagtgttaggattacaggcatgagccaccgtgcccagcaccatttgtatatctatttttattttttgttgaggctttctaattttcttcctacagatattactatttcttaaagttacttttagtgttttgttcttaggttcttatgcttgtctcttttttcattttattttgtttctgcttcattttgtttatcctgtgcttacattaacactgtctttttgtaggtgccattgattttgttacttattttctatttaagtgtgtagcctagttattgttgggagtttgtagttcttttttattatttttattttattttaatttcttgagacagagtcttgctctgttgcccagactggagtacagtggtatgatactggcttactacaacctccatttctcaggttcaagcaattctcctgcctcagcctcccgagtagctgggattacaggcacccaccaccatgcctggctaatttttggacttttagtagagacgggcttttgccacattggccaggctggtctcaaactcctgaccttgtgatccatccaccttggcctcccaaagtgctgggattacaggcatgagctaccgcaccctgccgggagtctgtagtttattattgtccttgttgttaggaaggctaatttttattagaagatagtgactatttagctaacaattttgttttgacatactgctatagctacctataagtttggggtgtgtttttacacattgtattattgctgttatggtttttggtgaatctcttaatagttttgataattataatctggaattttagaggaataatgcaaaatagagatcaaaataccacttttaacattgagaaagctgattagaaaatacaggtgattgaagaatggcaggtaggtatggtacttgggccatggctacctcaggtgcaggcactgaggcttgctcagcccaccttcaccaagctgaccgggacccccatggcagagagcaggcacaagtgcttgttctctgcagataggcagatatcaaacaggaggagctaagacaagtgtcggaagaagtgagaagccaacagtgttgctgtagtggaaatctcctgcacatagaaacatgaagaatggggagtaaatgcccctccccacacacgctcaaacctgtttaaatgggaatgcctattgcgtaagaactctgataaaactgatagaactgcagtttgtactaagatgctgtgttttcagatctcttaggaagagagggtttgaattattgaaagttaaaagatttttctgtagttccataatttatatgttgtatgggtttcagagattggcatttgatgatggtttgatttatttcagcaacgtgaaatcctgcatgagattcagagaaggaaagaagagataaaagaagagaaaaaaaggaaagaaatggctaagcaggtaccctatcaactccaccataataatttacattttgcaaaacaaagtgtttttatttccactgatgacatctgtgttactatcagtaatacagcttaaaataaagcactaaaaataaataaatattcactgtgtatttcagactccctaaataggtggcaaaatttagagttttatgttgtcagtagatgatttagacttacataattactgtaatttatcaaatgagggagggaagagattgcgtctttaataattaacctggactaaaattgttcttttttttgagacagagtctcattctgtcgcccaggctggagtgcagtggtatgatctcagcccactgtaacctccacctcccaggttcaagcaattctcatgcctcagcctcccgagtatctgggattacaggcgtatgccactacgcctggctaatttttgtattttttagtagagatggggttttgccatgttggccaggctggtcctcaacttctggcctcaagtgatccacccaccttggcctcccaaagtgttgggattacaggcgtgagccactgcacctggcctagaattcttaatacttggaaaataaaatgatttgttgatactgaagagggaatagaaaccatatggatctgcctgaaatttcatccagtgatgaaaaagagtaattcaacagagcagatttaaaaggcagtggtgaaaaaggatagagtgctttttcctttatttttcctgagtctagctcaagcaaaaaaccagtcagacgtgtttggagaaattcagagaaaattttactcattctcttttacataaattagagcattaaacttaagggacatgatgtggtagcaggaagaggcactgaagcacaagcaagcttctcctggtttaaagcttcagctttcctgctgcctcactttgtgaccttggcaaggtgacattctctgtgactctctttacttgtcccttaaaatgggactgataatgcctttctttctgtcttgtataattacctccacagataagtgtactgccctatgtgaaactaaacctgcgtaaaaatgtaagatgagatccctgtttccaccagtgctcctgtcttgctcctgacctgccttcctgtcagccactctctgccctctctttgattctcccttcttctgttcatctcctgttactcttctccctaactttttacactattgcaagattctaagcattttcatttataaaatttacattttcttgaaaccataacctggacttcagttcttgagccagtacatatttaggcattaacatttttttaattttattttttaattgaccaataatagttgtatatattcatggagtatatagtgaagttttgatacatataatgtatagtgatcggatcagggtaattagcacatccgtcactgcaaatatttagcatttctttgtgttggaaacattcaatatcctccttctagctattttaaacgattaaaagttaagttcaattttatttcacttgtaaacattcagcttaaaatttgcattctatactgaattaataattatgtaccatgattttcttccatgtatgacttacatctaaagtaagttttacttttcttgttctaggaacgtttggaaattgctagtttgtcaaaccaagatcatacctctaagaaggacccaggaggacacagaacggctgccattctacatggaggctctcctgactttgtaggaaatggtaaacatcgggcaaactcctcaggaaggtctaggtaagtccctgggatttctgatctgggagaatgacagatgtagaaggattttactacattgaagatgtagtgaaatttgatggaaatttcaggcgatagtcttaataacttttttcaaaccttatatatcttaatatattagcaatatattaggtgtatttttagcaatatgaaactaaattgcgtttaacactttccaagtatctatcatgaatctagttttgttgctcattccctttttttttttttttttttgagacggtgtctcgctctgtcacccaggctgcagtgcaatggcacgggctcagctcactgcaacctctgccttctgggttcaagcgattctcctgcctcagcctcccaagtagctgggactacaggcatgtgccaccacacctggctaatttttgtatgtttagtagagttggggtttcactgtgttggccaggctggtctcgaactcctgacctcgtgatccacccgcctcggcctcccaaaatgctgggattacaggcatgagccaccacacccagcctcattcccctttataacagcctataacacatcacaaacttgccttagtacgatttaacatttataaacttaaattcagtaagtgattttaaaatttttcttccatttgaatcatcatcatccagtgtttcagtctacaatgccttaggtcccaccacagttgtaaggagtgcctgaaaatgagcacaggtgagacatctgttacatgagagtaggaaccccagttggctgccaggggtcccctccctaatactgaggtgggctcctgggctgttccctgtcaccactggtcacttaaaagatactacttgttcttctatatctttttcactgaagaattccaactttgctctctatttgctgtggccccctgtacaccagaaaggaattttggtgaagaaaccatttatgagtggggtgggttattaaatagtgtagggacttcaaccttcattgtatgtttaaattatctcttgtgagactctaagcacaacttaaaaccaccactttgcttccatgaaaagaaacattttaggcaccaaactgaagatttatataaacttctgtatagtttgtttattagaaggagccattttagttctttccctaattatctactactaaaaaaacagttcagaaatcattttgacactaatgtttacctactattaggtttaactaaatttttaaaaaaatactgtttctggtaaccattcctttttaagattataactccttcccaatttaaattatttttgaatctgggcttctaataagcaacagagtttgaagttgtcagagaatttcactaggaaatatctaacaaatttttgttgtattagaacctttgaattaaatcaatgatataaataagtcttttcagatatatggaagatgattgttttaagtttaaacatttctatttttgtggctaactataaacagtgaatccaaggttaggcttgtttttgagatcagagatagcacgctgggcacggtggctcatgtgtgtgaccccaacactttgggatgccaaggctgaaggatcacttgagcccaggagttcaagaccagcctgggcaacaaactccttcccatctcagagcctctgccgacccctctgcctggactactcaacctctggcattttgcttgctgagcccctccttctcattcagttctcccctcaaatgcaaccttctcagggatgccttcctgagcccccctctaccctatttccctgctttgtcccttgctctccaattctctgctttattttttacataacacttagcactagctgaaattgttattcacttgtttactttggaatgtgaggtctgtgagagcaaagccctcatctgtgttttcctcaaagcctgaaatcgtgcctggaagacacatggtaggtgcctggtcaacatctgatgcagggagggagccagggagggaagatgacacagggaaagtgggacactgtgtttctggtgtttgtagggtctacagcctctttaaccagggcagttttgcttctcttgatctgtggggtatgtaaaaaaccagtgaggttttatttaacaaaagatgttcacgctgaaaagaagagaaagagagaaaagagaaccactcactattctagtggaaagaacgtaaaggcctgatactcaaaggcttttcactgatgagtcttggcttttgttgaagaactttattttctgtgcttcaagtcttcttttcccaccttgaaggattcactttttagaatattaaggtaaaaatcaaaaaacataaaattagctattttaatgtgtacagttcagcgtgaggctgtatttgtgaagtgcagacatagtccccccaacccactgccttgtttctgggatgttgctcctcataagtgggcaatatgaattttgtagaagaagcaaaactaaaaaaccaaaaaacctctataaaatagctcatggtagaaaattaccttcacatattcagacttgctgtctttgcagattaccgtagtgtagcccagaatctagaatatatcacctatttatatctaccatcaacaagattaggttatctagtttgttttccctattctaaagccaggtatggtaactgctggctcctcacccttacagagaagagatcattaagggtataagacatgggattctctctgctctcctcaaaaaacttggggaaccattaaagtataaaggtgtaggggagagaggatccttgatacgtctctccagacatggtcctctgttgttcagtttctgtggttggttccatggaggcatagactggtttacctcaaattaaacaatatcaggaattcttactaatgttgtctctacaaagtggctctgtgtttcaaattaagggacctagaactagcattttctgtggcatcttggtgagttagacaggaaggtgagactatccctgcccctgtgtctcagataagatcctctttctccctcctgccccaacatctacacattgatcataatggtagagcaatcttttggatggtagcccaattctctagtccccacttgaaaaattgtcatctctcttcttgccacttggctttttaaaaaaaaaaagattatccttttttcttttttcaggtatcaagctcctagctgcctaatttagtcatctaaaattgtattatgtttctctgttctttttaaagacctagattaatactatttggtaattttatttgaaacacccttcatataggttgggaactgccacagatacttggcaaaactgataacatgggtgatatttttaatattatgataatattgcaaacctcatgaacatccatactctagaatagatcatgatgatgagaccagagtcatagcttctgaacaccatttgtttgcactgtttctgctggagtacagaagtcgttttacttatgaatggattcaaatccaaaaggttgttccaagcccagttcttgatgggtcccaggtagacagtataagcatccaatatatatgaatctttttggcgaaaacaatagatatggatgacattgcatttgtctctttattccttcttttcaaactctgtgatttactttttatccttcagaattgtttctgctacaacctgtgccatgcagcatgtaccacatttgtcgttttcttactttcacttttatctctacttttctttcaatcctagttattccttaatcttacagccatcaacactcattgtgtttgtacttatcagtcataatagggtgattcacattctaaaactccttaaaaccaagcatttacacattgtaaacttaagaacagaaagatggcctagactaaaatgaccattagcaccatctgctgaggaggccagagctgatgtagagatgcttctgcatagtttatgttactaagtctagcatgtaattttaaatctttgcttttatccttttctccataaatctcagtgtgtccctagttgcacacataactttagaagtagaaatttgaacagaactacaatgtatttgctgttttctgatgtttagaatatgtggacatgggccaggtgtggtggctcatgcctgtaatcccagcactttgggaggccaaggcgggcagatcacgaggtcaggagatcgagaccagcctggctaacacggtgaaaccctgtctctactaaaaatacaaaaaaattagctaggcatggtggcgggggcctatagtcccagctactcaggaggctgaggcaggagaatggtgtgaacccgggaggcggagcttgcagtgagccaagatcgcgccactgcactccagcctgggcgacagagcgagactccatctcaaaaaaaaaaaaaaaaaaaagaatatgtggacatatgtgtggtgtaagatatgagtatcataatacataatcttgtcaccagtgtaggaggggtttgaggaaagagaggatgtgtaggattggaagcagaaagaccagataataacagagtattgcatatgtccaggagaaagttggagatgaactaaacagggcaggggagatagagaggagaaggtggtacttgaagaccaattagatgcagatgtaggagcccaaggagactcacaggtttctcacctgtgagacagaatggatgactatgcccctaaccaaaattaaagagtcaaggggaaaaatcaggtttagagcgagtggagggagtggcagttttattgacgttgcaatggtgtgagggataaatagtgcagaagtggagacaggaagtgcagtaatgtgactatgaggaacaggatggggcgggtggtgcagggttgagggaggggaatgtatggatcagagagatttataggctggtgggagggaacccagagagaggggctgactgaacatctgggagaaagggactaactaatagactaagatcccagaggagacctttgtaggggatgggactgaggacaggggtagccatccttcctcaaagtcacccacaaagaaagaatagtgccaatgccaagtaactttataggaggaacaatagaaattgtggactgtattcctcttgcctcgtgttctcagtgaaagtaaaagtcaaaatcatgctgagaatgagagggtgatctctctagagatctgtccatgcacgtcatcgaagtgtttctgataagtgttcaatcctgaccatcaagagctctctcccttgcctcttccctgcaaccctctcccctaatttattgtttttgcattatgatctagtttcttagctcttgctcccaccagaaaaaaagtagaaaaaaagaaagagaggagaggctgggttttaagtgttttggagaagtcatggaagggaatgatgggaatatctaccaaagacaagcaagagaaggaatgtgcactcaatggctggaggcccagttggaaaccaggaatttgtggcagctccaaccccctctgttttgcagctttctccagatgtgcatgtgcgtgggaatgaagcaatatgggatacctgtggaattgatctaaatcactgctgaccagtagaactttttatgataatggaaatgatctgtatctgtgctgtccaatatagtagccactagccatgtatggctattgagtacttaaatgtggctactgcacatgagctgaattttcagttttattttaatagccacagcattgggcagcacagacctcgagttaggggtttgtggttttcatgtggagaagatgacaatgggaagtgggggaagtgaatggctttcccattagcaccgcctactcaattcccagtagaaacagatgttagactgcgagtgggctaataaacagtaataaacgggagaaaatggaggggcattcttgcctatgttaatctataacattcctatgttaatcttaaagaaaaaaatgaaaaatgattgttcaaatgtattgttcaaatttatttttaaggcgagaacgtcagtattctgtatgtaatagtgaagattctcctggctcttgtgaaattctgtatttcaatatggggagtcctgatcagctcatggtgcacaaagggaaatgtattggtgagtaaactagcaaaatctattcatattattgtaatggcaaaagttaatcacaaaggaatgggatggattagacactgtgtcattcagaccagtgcagtccaaggaagaccatcaagctggtagtcattctggctcccatccttaatgactggaatgagaaatcactcaggtttcctctaatgtaagatggaaataaaaacctgtgtttttgtctgggcaccgtggctatgcctataatcccaatactttggggggccgaggtggaaggattgcttgagtccaggagttcaaagctgcagtgagctgtgatcatgccactgcactccagtgtgagtgacagaatgagaccctgtctcaataaaataaaataaaatttaaaaacctgtgctcttggaatattattaacataacgatcattttaaatctgtcatcattataattatccaagcttattgaaacaaaaaaatgattaaaatattatcagtcagtagaattttacatcatatacagctaatgctgatcaaatgtatgtaacaaagtgaattctaatgcctatgatcttttttgttgttgagacagggtgttgctccatcactaggctggagtggtacagtggcacaatcatagctcactgtaacctcaaactcctgggctcactcaatattctcccctcagcctcctgaatagctaggactacagtaatgtctgtggtctttattgaccagatctcattttcttaagtggatatccatccatttggcattttcctgcttgacatattatacctgaccaagaagaccaccttattttctatatgccttatttagaagttttgtctactcgtggctgtttggcgtgaagctggttcagcaaatcagaatttgaattgctcatactaaagtcaagtttttggtatttcttcctttaccctaaatgtatgtcatctttacccagccttacagataaaaccagtaattggtatagaaaccatttgtacatagtgaatttggcaattaactttcattttcaatcccatgcatatttttgccagaagtaacaggtagccaaattatgtgaaatgagtttgctttcttttgggatcttttccccttcctctttaaggagatacaaataagcaaaagagttgccaggaagcagccagcaggtggagggagaagaaaccaaacttctcaataatctatgagctaaatacttaaccttggcagacacacagcagcctggacagtaaaggatcctgcacatagacagagctgccatatttagacaaaggaatcattgggcaggttcaagacattggtagtggtggttggctttagacctgagactgtccttgactcagacatttcagattcatgaagtgacaacataaaactacttctaataacctggggaaatcaagaaggcaaattaattcaattcttattaccttaacttagtctcttattctcactggtactcattagacagattcaccatagttaatacccttattaggaggcacattttcagttggagaatttttaataaaattaccaagtaaattattcattttgttttctcacagtgggtctgattttttaaaatatgccctaattgtctatgaaatgtttttataaaagattaactactaatttttttattttcaatgaagtatttttataaaaaacaatatttgtttttcattttaaagttgttagaactagacagaggagagaacttacttatagatatgactatagcactatagagactgtctgcataaatgatcattgtgggcatatagggtttcagttagagttcttttgataatgtattttctcttagcctcgtctcagtatattcttttgtcccttttattattcccatcatgaaaaactgacaagaagagtctggcaatactaaaattataattttttaaaccccagcaactatgaaatgcctgcctagtcccaattagggaaacaaatattgcaaaacactgtactgcataacacacaaatttaattaggctttatgtaaataacgtcttactccatcccataaacatttaatgccatgtgtttctagtagactgcttagatcccacatttctcaggttgcttcgtttggttgacaaatttttaaacagcaggattttttccccttaggcaaagactgtcaggagttatttatgactaacagatcattttaattaaaatctctaaattatcagcattcccatgaaataaaaactgcttgtcagataaaaagtcaaagtgagctagttcagccatatttttccaaagtatttttgctgagacatctttatcatgtatatgcaggttacttcacctttgattattcaaatagaaaagataattagcaatgtctctttaaaaatttgttttcattatgaagatagtatagcatcatggaaaactattatttatataagagaaaaaggcagattactatatatcggggttatcagctgggggccattttgtagcctgcaggacatttgatgatgtctgcacacatttttgatggctaacattggggtcggggtgctattggcatctagtgggtagataccaggattgctgctaaaatcctacagtgcacaaaacagctgcctacaacaaagattacctggtccaaaatgtcatagtgtcaaggtgttatatatatgctatgatatggtaaattatggggtaaaggagaatagagggaactaaaagaaaaataaaacaagtggtgatttttttctccttttccaattttttagaattttctattatggttttaatgaaaatagagatttttataagaaaatttttggtgttacagaaatttagctctccctgtgtaagtgagaaccatatgactatcactaaataaatgtgtctcattttctagcttcaaatctaaactgtcatctcttgttctttccttccaaagcattgaccagtttgtatttactgagcatattcaaattttgcacttagaaagtcattgatgtattcagattttcaaattactgttttactgtgcacactaatctataatgatctcgatggcttgttctctattttcatattctttctgtcattttagttggtatttagctgtatgagtgtacaccagtagacacagtcagcaaaggtagactcgttatgaaaataacattgtgcataatggctagtagcataaaacactggcctcttttgttttttgagacagagtcttgctcttgtcgcccaggctggagtgcaatggtgcgttgtaggctcactgcaacctccgcctcccaggttcaagcgattctcctgcctcagcctcccaagtagctgagactccaagtgcccgccaccaaacctggctaatttttttgtatttttagtagcgacggggtttcaccatgttgtccaggctggtctcgaactcctgacctcaggtgatccatctgccttggccttccaaaatgctgggattacaggcgtgagccaccacgcctggccaaacattggtctctttatttgcctgatactaagatctcattgtagattcttgccccttataaaaaattattttaggactcaggtatattgctaaatatcaaaaattgtttacaaaaggacattattacataaagtcctattttccatagttagcgcatggtatccattgttgaactaaagaatgtgtattaccccctcccttccttcccccaagagaaaacataccagtgggatttaattacactttctgtttaatgtgcaggcagtgatgaacaacttggaaaattagtctacaatgctttggaaacagccactggtggctttgtcttgttgtatgagtgggtccttcagtggcagaaaaaaatgggtccattccttaccagtcaagaaaaagagaagattgataagtgcaaaaagcaggtaagcatccaaggtggctgactgagcaaaaggcctaatctcaggctttaggagatgacagaacaaaatagccctgcatttgtttgccctgcagagatggtccagagcagtatgagaactgtttgaccagggaggacagtgaaggaccagtacctctttgccccttgcctctggtttcagaactttcacaacatgatcaaagcacttccagctgccttcttaacctcctttcttagcccttagtatggcattaacagtcatctttccaactgggactaaatactagttcataattgggtttttttgcaattcttcttttccctactcttgaaatattgcttcagggctgggtgtagtgactcatacctgtaatcccagcactttgggaggccaaggtaggaggactacttgagcccaggaggttgagaccagtctgggcaacatggtgaaaccctgtctctacaaaaaatttaaaaatctgtgggcatggtggcacatacttgtggtcccagctgcttgggaggctgaggtgggataattgcttgagcccgggaggctgaggtgggataattgcttgagcccaggaggttgaggctgcagtgagctgtgttcatgccactgaactgcaacctgggtgatagagcaagaccctgtctccaaaaaaaaaaaaagaaaagaaaaatactgcttcaaaactgaattttgggggaccggaggatttttaagttaatttataaattatgatttataaccaagcataaggagaacattcagtattgcatattgcagtgttacataataacaaggtttacaaaaacgtagataaagcatggtgttcagaaatgtgtgtgtatttaagtatagaaagaaaactgaaagtaaatgtgccaaaatcttgagttatcactgggtggtgaccacatagataacatgtgggtattttctatcaaactaattttttaaatgttgacaatgatctttattaaatcagaaaagattttttttttctgtcttcaaccttaactcctctttgccatgtgaggttctgaggattaggatgtggccattattctgctgctcaaatcatatactatatttttaaaaacccaaatacaaagctaatcagaaaaggttatttttaaattaaagtttgttttttctagtggctatacctcaaaagaattttattttaaaaactgttcactaattttgtagtatatgcatagtaggttttgagattagagaagttgagaattagctaaattttttccatctttatgaactattagattgaccatatggtttggggaggattcagtttagggcatatttgttctcctctcatttgaaagtatattttctatcaaatacttcacttttggttttggttttgtttttttatgcccccatcttgtatgatcaaatacttcacttttgaaatgaaacccaagttaatgttgactggcccaatattctttttttttttttttaacttatcagattcaaggaacagaaacagaattcaactcactggtaaaattgagccatccaaatgtagtacgctaccttgcaatgaatctcaaagagcaagacgactccatcgtggtggacattttagtggagcacattagtggggtctctcttgctgcacacctgagccactcaggccccatccctgtgcatcagcttcgcaggtacacagctcagctcctgtcaggccttgattatctgcacagcaattctgtggtgcataaggtcctgagtgcatctaatgtcttggtggatgcagaaggcaccgtcaagattacggactatagcatttctaagcgcctcgcagacatttgcaaggaggatgtgtttgagcaaacccgagttcgttttagtgacaatgctctgccttataaaacggggaagaaaggagatgtttggcgtcttggccttctgctgctgtccctcagccaaggacaggaatgtggagagtaccctgtgaccatccctagtgacttaccagctgactttcaagattttctaaagaagtgagtatcactgagattctctctaatagcactttactcctgtacttttgattgtgctggagtgtgccagacatctaagtgatgtggaagctgagaagtgaggaacaggacttcattctttgctctcccaatcctgtcctagtctcatatgttctgttttctcatgtaggttggtgattctcttaactaccacattctctgaaattcacttggaattcacacttgattttcaaactccttttgggggactgatgggatactcttggaagtcaatagagatggttatggtgagaaatgccctaggtattccaaatactgacctttgctctggttcctaaagggtcaaagacgaggctccttattcaaaaacagctttgggagtgagattctgccccttgtgcttcttaaccattcttcattggctgtctcattcatttaagttgtagaatgcaaataacttccttagtctagccagaggagtttcaatacctgtaaatcacaggtgcatgtttaattacaaagccaagttttatccaatttgggagaacccttcttgagatgtttcctcaggcctaagatgtttgtccaggtccttcacttaagtgttttctaatttcgtcctgcctctgttttcagtccaagccagagctaagttctgtcagtttctgttaaatgggagataagatcccttcagtctggatttttccagatgctcctctggtccagctatcctgcaggagttgacctgggctggtttcttccctttctgacactctttgttttttaccttctttttcccaatcatttgcttttattcacttcttccatttgcaacatttcttttacccttcacatttctttccctattccacctatcgcagtagccagttggcctggtttacattgttatgctctgtcactgatggtcttaccattacagatgtgaaagtagctgcacctgtgtttgagattgtttttgtgtaaagtgaatatgatatatatatatatatatacacacacatacatacagttgtggaaaggggccaagtttgattctttatgttggtttctcgccttgaagtatatgaaaatattaagatttctaaagaaatcttttatggtatctttttaatgcaatggagctttaaacatatttatttaaatgcaccctaacaatgaggttggccaaaatgacaaatatgatgatagaatcacagatggaaagtttcatttccatcttcaaaatgtcacctttagtgttctgccttcttcattgatgaagagtaatttagtcaaggttagcaatagcatcatgtgttgttaaaaacagtactgggaggtttaagtagaagtacctttcctttcccgtttagtagcaaaatgaatgggctcggtaggtaaaactttcctagttctcttcttaaatagctgtatgctctgtcagttttaaacttgagatcagcacaatttcttattcttttttttttttttttttttttgagatggagtctggctgtgtcgcccaggctggagtgcagtggtacgatctcagcttcctgcaagctccgcctcccaggttcacgccattctcctgcctcagcctcctgagtagctgggtctacaggcgcccgctactacacccggctaatgttttgtatttttagtagagacagggtttcaccatgttagccaggatggtctcaatctcctgacctcgtgatccgcccacctcggcctcccaaagtgctgggattacaggcgtgagccatagcgcatggccttcttattcttttaacaagatttttctttagactattttgtatacttctctccctggagtggtttgatagactgtgcttggttaaggagctgccaagaactgtttttatgaactttgctgtccagccctggttaacaaaagaaaaatgccattcacaaagaatgaaaacagcaaccttccatttgtagttatatttttacatattagtgaacaccctttggagcaagattttgtttcaaatcagcctctgtgatgggtaagactctggagtcaaaacatctgggttcaggtctcacctctatgtcctactggctgagtgaattaaccccctgccctgcgtttcctcctctgtgaaactgggataatagcactgcctacctcatgaggtggttgtgaggattaaattagttaacagccataaagtgcctggcacttggcccagactgagtcagtgctggttttcatcaccatcctcagtagtgagaactatgaagaaatgtgggtgttgccaggcattttatccctttttgttcaaagctgaaccttttctatatacggctaccctgttgccaaaattattgattcagagaagttcatttttaaagtgagatcttggtggctataaatctcttaaaaatactgtgcattctaggtaggctgtaacatttttctgatccagatttactttcaagtcaataacatttatgtcacagttgagttacagttgataacgcaattcagaaacccaacagggcatatatagggatgctcattgcagcattttgtgaaaatgtgaaaaattggaaataatctcaacagtaggagaatgtgtaaataaattctggtaggtccacgcctatacagaagtttaaaaaaaatctttaagtactggcttagaaagagctccaagacacatggtggaatgaaaaaagcaagctgaagaataatgtatataagatgatattgcttaaaaaaatcaaaaaacaatactattttgtttggatggttgtatgtttatgtgtataaatgcatagaaaaatctctacaatgagacaccctaagtggaagaaagaattggaaggggaggttggtcaaaggctttatcattatcagtaatgttttaatatttgcaaggagaaggtatatatgttttaatgatataattaaaaagtaattttaaatttaaaggaaaatacggtatcttatacaaatggttttattagaatttttttgcctgttcaagctatgaaattaggagtaccttgctttttactgctgcaacataaaaaaaagttaccatttatgatagttgctgtcaccactttgtatgtatagatttttaagtccagaactcacaacgacagttgattcttttaagtatattgttttaattataggtcaagtgctaccaagtcgtactacttgggccgttgtaatgaaagtagcttggcatggtggttcatgcctgtaatcccagcattgcaggaggcctaggtgagagtatctcttgagtccaggagttcaagacctgcctgggcaacatagtaagacctcatctctacttttttaagtattccagcacagcagggcgtgatacctcacacctgtaatcccagcactttgggaggctgaggcaggcagatcacttgaggtcaggagttcaagaccagcctggccaacatggcaaaaccccatatctactaaaaagacaaaaattagccatgcatggtgacactcacctgtaatcccagctacttgagagcctgaagcaggagaatcgcttgaacctgggaggtagaggttgcaggttgcagtgagccaagatagtgccactgcactccagcctgggcaagagagcaagacttcgtctcataataaaataaaataaaatgaaaataaataaacaaaacattccagcatggtggtacacgcctgtagtcccagttactcaggaggctgaggcaagaggatgctttgagtctaggagttcgaggctgccatgagtgatgatcgcaacactgctttccagcttgggtgacagagcaaaaccttatctcaaaaaaaaaaattaaaattaaaaaaaaaggccagcttaaatcagttacagtttaactacttagactttaacttagactttagcttgcattgaaatcatttggagctcttgttaaagcacagatcactgtccaaacctccagagatgctgatttactaggtcaggggtatagtagaatttgtatttctaacattttttaggggatactgatgctactggccagggaccccactttgagaagccctgggttaaaggtatggcttgtttttcttcattaaaaaacaaaacaagaattgtctattacaccattaaacagtaagttaatgggttcaaggaatgaagattaaaagaaagtatatgaggccgggcacggtggctcacgcctgtaatcccagcactttgggaggccgagacaggcagattgtttgagctcaggagttggagaccagcctgggcagtgtggtgaaaccctatctctacaaaaaatataaaaattagccaggcctggtggtgcctgcctgtagtcccagctactgagatgggaggattgcttgagcccgggaggcagaagttggaatgagctgagatcacaccactgcactgcagcctgggcgatacggcaagaccctatttcaaaaaaaaaaaaaaagcataaaccaatttttaaaaaaagtatgcaatagaatatgggactttaaaaaagccttccctaaatgtttccaacttgcttcatcctgtaatgagcaggcttcatctaaagctcgtcatactgagccactctgctgcaccaactctctgatttgctttgtctttcgaaagctttatttataaccggttcctgcaaaggcttagtttggcatgacaaggcattaaactgttcatcgaggtgaaaatttatagcctacttgtgctaccttagacttttaaaaaattgttccatgagggtaagtcttctcatctagagatgcctttttttgattcgcctcttgtacccagcctgtcgcatagcatgtaaatcctgcaggaatgtttattaatttaaattcacctatgagagtacattctggtctttgagtaacatgaattctataatgtgtatctttaaaaaataaacccatagttaatgccttggattaactagtttagcactgattgtttgtgatgctaagattcttccttccctctcaccgagatgtgtgtgcttggatgacaaggaaagatggagtccccagcagttgttgaaacacagctttataaatccccagccaaaaatgcctctagtggaacaaagtcctgaaggtgagtctgttacctttctttatttggtaacctgtttgacattaaattattttgaaagtatacataaaccaaaaactggaaggggctgcatgtgttattttatgtcttttattctgaactaaatccattagtttgatgtgtgccatgtgcatgggactgttttgccaccctgatttttctagtctctattgatggaatgaatgtccattgctgtagtctcttgtagtgtttagtcacccatagtgccatgtaactagatttttcctgctgcacctgagattaaggaacctcggtagagattgggatggatcatgagacctgagttttggttctagctctatagttaagtcacttattctatataatcccccacctgtaaacttgggctaattatatatttctgcctactttaaggagggcaaggtgaggaaaagttttaaaaggccactcaggtaagaggtaatttttcaaactactggttggagctcttcttccagggcttccatcattgttggctatgtagctcttcctaaatttccaatgcctcatgtgcctcttactccctgttttatctcagattctgaaggacaagattatgttgagactgttattcctagcaaccggctacccagtgctgccttctttagtgagacacagagacagttttcccgatacttcattgagtttgaagaattacaacttcttggtaaaggagcttttggagctgtcatcaaggtgtggtacagagtcattcccagtcccctttagagctccttctctgttccatttccacaaagactcatggactttacttttattttgggagtggggagggaagtgaatatggctgttggatactatgctcatcctcaccttcctggagttaaaggttttatttaagttacgctggacacagttgagaattgtcccactcctctttccttgcttcatgtggagcattaacatgaaacacacatggttataacagcacttcaagtggaatcaagacctccacagaaagaacatttttgtgtgctttggttcagaaagaacattgttctttttttctcctgtttgctgttagagttgctgtagataaaaaggttctaaggttagaagagagatggacttcaaactgggagatggccccagcaggtctcgatggcttttattttccagctattattgggacaggaaagtagcgatgtattattaaggtacactgttgttgggtcttcctttcttcgttctagtctatttgggtgacttttattattatctgccccttgtagaaagaggtttcagctgtttttatataatagaagtatttctttgtaaattaggagacccagattattgtattaagtccatatacagtacatgtcatctttcacatatgaaggtaacccaccatcaactgagtatattgtctgttaaggattctgagagtatcattaggaagcattactgttactgtagaaaaacttttacactaaaaaaggaattaaattagttttcctgtggtaaaagacagacaagcaagacagatgtcctgatcagaaagatcataattatgtctaagaggaggggatgattgaagcgtatactgtccctttaacacaatatcattttgatcaaatcctttaacttcattctattttaaattcttgaacgtagaatagtaacaaatttcatctctttacaagtacttaataatgataggcaagctcatataacaaaaacatctgagtaacttaagcccccacggtttccagtagtttctccctgtgagaatccacagccctcacctcctacctctgtgcttctgtgtcagagtagggcagcctgcccagtgatctggcattcattagcagttggacccattactgtttctgcaccttttcacttcagtaaatgaattcctaggggtttccagtatagcaagctttactcccaacccagttcgtatatgatgtgtactgagacaggagatcgaaaggcaatgccaagatccccacctcccgccctacactgtcctcttccctattaatgtggcagtaaaagaacacagggctatcattttttggagcacctgccatatttcagattgtgtgccaggtgatttacaaaccttgtctttaaatctcaggacattcttacgagatgggtatgatcctcattccctagatgagggaactgaagctcagagaaggttatgtcctttgcctgagataagggagataaaaccagcattcagacccacctctgttgtactacaaagtgtgtgttcttgtcactatttccatacaaaaaaagataatctgaaactcaattttgtagtacttccttcttattcccaggacttcacttagacttttattagtttaattgaaacttgtgagccaaacaagagaatgatattctgttttgtgttttgtaatcaactaatttctcctgccacccatggccacatggcatttgcttttctagagtatatcatcacctcagttgacctgcacggatgtgactacaaggtttcagtgaataagactctgtaaaagttacttcagtcaccccaattacatagtgaaactgcctggcataaggatgcctctatgtaggatgggaggacttgcctttgcaacgttttcttgctttcttattattttactgtgttgttaattgtattgttctggtttcagtatacatcatcttaggtatataacaaaatcaatgggcagtgattgtgttaatagcaattgctgttattgactaagctaagcacctttctctgtgaggccttgatacaagtgctttacagtcaccatttggggtagtggaaatggtataaatgccattttaaagataagaaaattgagtctcaaggaaattaagtaattttcccaagttcacacggctttagaaatcaaggaattaacctttgtgttcaggtctgttaatatttttggtgtttaatttgtttttagtgactttaagtgtaaaaaaaaatcagagagaaactaaaatcatctgaaactttacactgactttagaaaataatttttaatcttaaaatcaagacacttagaaatttagatagcagatacattggaaaagcagggaggtaactgtcagtaaaattaattattaaaatggagattatgttttccccagggtctcccagcaagctaaatatatctagagtcgggtgggctgttttctgaattttgtggcagtcaaagctttcttcagtttaagaatttcaggcatgtggttcttgactgtagctgtgggactcatttagaacttcacgctttccttgggaggggatggggtgcggtgcaaatgcctgtttgtgcaaggctccgagcggctgaccttcccctggctgtgccgcaggtgcagaacaagttggacggctgctgctacgcagtgaagcgcatccccatcaacccggccagccggcagttccgcaggatcaagggcgaagtgacactgctgtcacggctgcaccatgagaacattgtgcgctactacaacgcctggatcgagcggcacgagcggccggcgggaccggggacgccgcccccggactccgggcccctggccaaggatgaccgagctgcacgcgggcagccggcgagcgacacagacggcctggacagcgtagaggccgccgcgccgccacccatcctcagcagctcggtggagtggagcacttcgggcgagcgctcggccagtgcccgtttccccgccaccggcccgggctccagcgatgacgaggacgacgacgaggacgagcacggtggcgtcttctcccagtccttcctgtaagcgcacggcgcggaccagctgcctctgatgcgccccctagtttcctttctttatttttttttcctttttcctttcatttccttccttccttctttccttcttttctttctttccttttttgagatagggtcttgctctgtcacccaggctggaggtcagtggcgcgtccttggctgcaacatccgcctcccgggccagcgaatgccccccaacattaatccccaccaagtccaagccagggaaaaggggattcatttagaaatccagacgtgttgaccatgtttaaaaacaaaaacaaaaacaaaacaaaaccaccacttttagagagtaaccaaatgcaatctaaaggagcggtccccagcgtttttaggcaccagggactggtttcatagaagacaatttttccacagacgggtgttagggaaatagtttcgggatgaaactgttccaccttacatcatcaggcattagagtctcataatgactgctgaaaaagcgcacaacctggatccctcgtgtgcacagttcacaatagtgtttgcgctcctatgagaatctaatgcggctgctgatctgacaggaggtggagctcaggccttaatgcttgctcacctccggctgtgcggccctaacaggcagtggacctgtacctgtccatggcctggaggtttgggacccctaatctaaaggattttttttcccgctattttcaaaagatctccaaaatccaagccatggaaaaaggaaaattcaatacctcatcttatacattgaatagaatttctcataggacattcctttggataagggcttgcaaccctgtgaaacatttaagaactaatttggagtcttgatacagtgccaactgcagcccccaaaggtaccaaaccaataattatgatcctaaattttatgcttctcagaatccaccctggatgtttactttcatgattttgttttattttatccaagtggatacagtttatgattactcttcactattaaattttttgaggaaacttaatctggctaatttttattaaatcaagggttctgtgttttgcataatagcaagtacaaatcagcacagtgtagagtatacattgatgcctgtgggctcatggtgtgatgtctgtagcctcttgtgctttctagtatttaaaaatgtccatgtttataatgataatagggatttctgttcctttagtatttctgtttccctttttcaggcctgcttcagattctgaaagtgatattatctttgacaatgaagatgagaacagtaaaagtcagaatcaggtatatatatgaatagaaattatatcattttattcgtgatataattgacgtctgatgtcataaaccttaggtaaagtattaaggctttaatctgatattcagatatagaaaccataaattttaaaagatgattattcatttaaaatatattctacctgtgtttatttatagaccttctttatttatccacatagtaaaacatacctccttttagaagagaggagtcagttgagacactgcatttttgtatgtgatgaaaacagttttctaagggtttgggaaactttatatggttggggataagaattgaatgcaaattaatgaactagatttgcatttatggagttacctcatcatggagttaccttggtctgtcccacgtcaattaatcttgattccttattttcatagaccatcctctagaacagtgttttcacactgtgtatcgtgatcctataatgcaggggtgtccaagcttttgtcttcccttggctacactggtagaagaattgtcttgggccacacataaaatatactaacactaatgatagctgataagctaaacaaacaaaaaaatcacaaaaaatctcataatttttttttgagattgtgctgtttttttagttgtgttttcaatggagaaatacatcatctgttgacaaaatagcttttgaaaaatacgagtacagatactataaaacaaagcaaacttcagtcgtgagacactacatacatcatgtgaaagcaacagtctgatctccaggttgtgaaaactataattaaaaagtcactacacagaaaagatccaagtttccaggttggcaaaacttcggtgcagttacatgaaacgtttaacaaactgatttgttttccccaatgtgtaaacaaaatgacaagactaagtctgtgcctggtaatttcaatgtaactctgaagctacacaaaacacacagacaccttatacacttcacctgttagtatgaccatcttttttgttaggtggtgggaggaagggcaaggtgactgtgtaaagcaaagatgtgggaagtagaaatattatgtactagacgttataaaatcatggtgaaaagaaagctttgattaatgcgtagcctaagggggaaaagactacactccaacttcagaaaattaatttagaaggataggggaagagattaagtaattgcagtttaacatgaaaaatgcacatgtgatagaatggagcacaatggaagattcataaaacatgctcatcagaaaaatctgttaagtttactttgtccagattaagaaagagtaagtttatcaacatctggcatccctcatactttgtaaagatagatcttctgctgcttaattatgagaaattattttattcaaagaggggagcttgtcaagtgcttgctagaaattatttttaaaatgcttctacatgtaaaatgtactgacaaattttggtaaaccatttaaaaataagaattagttttgaaatcttggagaaaatgtctttttgcccacatttaaaactgaaaatcaattttactatagacaggagttctgtggagtatacaaaattcctcttagaaatcaaatggccatcccagatagatatcaagtttcacaggcattacttttagtcagtctcaagtttcagccacgggaccaaaatttagtgttctgtaccatgttggtttcacatcacggcttaagaaaatactgacattttgtttcttatgaaataagtcctatcttgtgcatacaagcaaaaagaaaaaggaagaaaagaggggaggggaaggcgcaagaagctcttttttgtttgttttgaagacaacagattgaaggcaaaagaatacagagctttcataagctcaaagaaaaatatttgctggctagtcgctgatttgtatgcactataaaacattccataaataaaactgatatatcatttcttaatcatgaccccatcaaaacgaagttatttcctaactattctttcaacgtcaatgtaccctagagttgacatttcatttttaagggttgcagctacctcataggaactgaaatagacgtacgcttaccctttctctgaagtataacagtgcacaatggtatccaatttgaagactaatggtaaagaaaattcttcagaaaaaactgaaaatccatcaagctgaaaatctataattagttctactttctaataaaaagtacataaaagtacatcatcagaataaataattcttatgccagtttgtattgcaaattttccaaacaatgcatcaaacataaacccaatccagatgtcaattgtgaatacaaatagagcttgaggttgtttttattaaaggcagtaatttttgaaatagttaatgcaactgttgctaacacaataataggactcctggcctcacatactaacctggacttctgatcaagtgctaattagcccagtaagggaggtcaccaaaaactactagggcagtcagttgtggctgtggggaattattctactattggggactgaatgcaacaactttattactattattattttaagaggcagggtctccatctgtcacccatgctggagtgcagtggtgcaatcctagctcactgcagcctagaactcctgggctcaaatgatcctcctgcctcagcctcccaaagtgctgccattataggtgtgagccaccatgcctagcctgcaatgactttattaccaggaataaaaatataattaccagcagttacaagggttcattcatagtaaagaaaagtctaagtgtagactcttaaataagcagttcaatgtatttgaaggagatctgagtattagccagtgtgtttttctataagtactttccttgtcaatgaaatcactactaataaacatttattagttataaatttaaaccaggaataatagcataaataaactatgttggctgcagtggctcacacctgtaatcccagcactttgggatgccaaggcaggtggatcacctgaggtcaagagtgagaccagcctggccaacatggtgaaaccccatctctactaaaaatacaaaaattagccaggcatggtggcgggcacctgtaatcccagctactcaggaggctgaggcaggagaattgcttgaactcaggaggcagaggttacagtgagcccagatcacgtcattgcactccagcctgggtgacaagagcgaaactctgtctcaaaaaaaaaaaaagtctgaactactgctaaagccaaagttaatgtttggtgttagcatttgttatgcacataattattacaggggcaccaaatcctggttttgctcagttaagggcagcatccatgggcatcctaattgatgggtagaaacctccaagagattaacagtgtaatacagataatccccagcatccataaatgattcaggagtagaacctgattgttaccagagcagagcttttttttttttctttgataaaggaaaaagttcaaaaaaattcttcctcagaaaaaaattataaatcagaaatggtcaaatactaactaatactttttctgcacttggtgttataagtattcaaatacatctattgagggaaaaagacttttttaagaaaagtatcatgtatgagaaagaaaattagctgttggggacaaacagagtaatggtatgggaagtgtcctagagggtcattcactgtaagtggcagctgagggcatgttcttcaagcatgtacctctgagggcagtgtgccctttgataatgtggtcactttttttttttttttttttgagacagagtctcactcatcgcccaggctggagtgcagtggcacgatctcggctcactgcaagctccgcctcctgggttcacgccattctcctgcctcagcctcccgagtagctgggactacaggtgcccaccaccatgcccggctaattttttgtatttttagtagagacagggtttcaccgtgttagccaggatggtctcgatctcctgacctcgtgatccgcccgcctcggcctcccaaagtgctgggattacaggcgtgagccatcgtgcccagccatcacttttaaattgttttacctaaaggtggatttctagtcttctgtttctgaactaagcctaccaccaaaaaatatggaattccagtaaaactgaacccttcaaatattagcctgtatgcattctgaccttcttagccatagatggttatcagcggtaagaaagaattgacttgacaaggagtttttctgtttaatacctgcctattttctgtttactgtatcattgttctgtgtagcaacagacctgtaaaccacacagaggatactggaaatagcacattttcaataattctgtgagcttcttttttttcctttttcttttcttttctttttttaattacacttaagttctgggatacatgtgcagaacatgcagttttgttacatagtacacatgtgccatggtggttgctgcacccattaacttgtcatctacattaggtatttctcctaaagctatccctcccctagctccccaccccctaacaggcaagccccaatgtgtgatgttcccctccttgtgcccatatgttctcattgttcaactcccacttacaagtgaaaacatgcagtgtttggttttctgttcctgtgttagtgagaataatagtttctagcttcatccatgtccctgcaaaggacatgaacttgttctttttttatggctgcatagtattctatagtgtatatgtgccacattttctttatccagtctatcattgatggacatttgggttgattccaagtcttcactattgtgaatagtgccgcaataaacatacgtgtgcatgtgtctttatagcagaatgatttataatcctttgggtatatacccagtaatgggatggctgggtcaaatggtatttctagttctagatccttgaggaattgccacactgtcttccacaatggttgaactaatttacactcccaccagtagtgtgaaagcattcctatttctccacatcctccccagcatctgttgtttcctgactttttaatgatcaccattctaactggagtgagatagtatctcattgtggttttgatttgcatttctctaatgaagaccagtgacgatgagctttttttcatgtgtttgttggctgcataaatgtcttcttttgaaaagtgtctgttcatatcttttgcccactttttgatggagttgtttttttcttgtaaatttgtttaagttccttatagattctggatattagccttttttttttttgagactgagttttgctcttgttgcccagggtagagtgcaatagcacgatctcagctcaccacaacctgcacctcctgggttcaagtgattctcctgcctcagcctcccaagtagctgggatcacaggcatgcgccaccatgcccagctaattttgtatttttggtagagaaggggtttctccttgttggtcaggctcgtctcatacgcccgacctcaggtgaaccgactgcctcggccttccacattgctgggattacaggcatgagccaccgcgcccggcctggatattagccctttgtcagatggacagattgcaaaaattttctcccattctgtaggttgcctgttcactctaatgatagtttcttttgctgtgcagaggctctttagtttaattagatcccatttgtcaattttggcttttattgccattgcttttggtgttttagtcatgaagtcttttcccatgcctgtgtcctgaatggtattgcctaggttttcttctaggattttcatggttttaggtcttacatttaagtctttaatccatcttgagttaatttttgtataaggtgtaaggaagggatttggtttcagctttctgcatatggctagccagttttcccaacaccatttattaaatagggaatcctttccccattgcttgtttttgtcaggtttgtcaaagatcagatggttgcagatgtgtggcattatttctgaggcctctgttctgttccattggtctatatttctgttttagtaccagtaccaagctgttttggttactgtagccttgtagtatagtttgaagtcaggtagcatgatgcctccagttttattctttttgcttaggattgtcttggctatacgggctcttttttggtcccatataaaatttaaagtagcttttcctaattctgtgaagaaagtcaatggtagtttgatgggagtagcattgaatctataaattactttgggcagtgtggccattttcacagtattgtttcttcctatccatgagcatggaatgtttttccatttgtttgtgtcctcttttatttcattgagcagtggtttgtagttctccttgaagaggtccttcacatcccttgtaagttgtattcctagatattttattctctttacagcaattgtgaatgggaattcactcatgatttggctctctgtttgtctattattggtgtataggaatgtttgtgatttttgcacattgattttgtatcctgagactttgctgaagttgcttatcagcttaaggagtttggggctgagacaatggggttttctaaatatacaattaagtcatctgcaagcagagataatttgacttcctctctttctattttaataccctttatttctttctcttgcctgattgccctggccagaacttccaacactatgttgaataggagtggtgagagagggcatccttgtcttgtgccgattttcaaagggaatgcttccagcttttgcccattccatatgatactggctgtaggtttgtcataaatagctcttattattttgagatacgttccatcaatacctagtttattgagtgtttttagcatgaaggggtgttgaattttatcaaaggccttttctgcatctattgagataatcatatggtttttgtcattggttctgtttatgtgatggattatgtttattcatttctgtatattgaaccagccttgcatcccagggatgaagctgacttggtcgtggtggataagctttttaatgtgctgctggattcagtttgccagtattttattgaggatttttgcatcgatgttcatcagggacattggcctgaaattttctttttttgttgtgtctctgacaggttttggtatcaggatgatgctggactcataaaaaagggaggagtccctctttttctattgcttggaatagttttaaaaggaatggtaccagcttttctaactaccatcagagaataccataaacacctctacacaaataaactagaaaatctagaagaaatgtgtaaattcctggacacatataccctcccaagactaaaccaggaagaagttgaatccctgaatagaccaataacaagttctgaaattgaggcagtaattaatagcctaccaacccaaaaaagaccaggattcacagccaaatgctgtgagcttctaaggatagtggttatgttctgctcactgacttctccctaaggcaactgggtggccctgtgttgggggtgggcacaaatacttaatgatggtgatgattttgcttaattttggcctccattttgagttattgtgtgttcgtcttgggttaggatgaagattgcaatgaaaagaatggctgccatgaaagtgagccatcagtgacgactgaggctgtgcactacctatacatccaggtgaggtcgtggtgtgtagttaggtgacacagcaacacccagtagtggcgggtgggcctgtttcagggtattagaacaagataatggacagaggagggcttattgccactaccaaagattaattggccgagaggattaccatatggaggcccttttccccagccttgaactcatgctttcctgccacatatcaggagcagccacagggcagctctgggctcaggctgtgtaagttcacatcctggatccacctgttaggactgcatgaactcgggcaaggttcttcagcatcttgtgcctcagtttccccatctataaattacataatagtagttcttatagacttgtaaagaataaataacatgtgaagtacttagaaccatatctgagttccataagtgctagactgcatgagcacagaaactctactttgcctaaccacctgaatctggacaagtaagatatgatgtgcacacatgcctgtacatgcaaaagtaacaccaaggtgactttaggcaaagtggcttgaccaggaacctctggagaccagtgcacaggcaagccagttccaatggggcatgactgagaagtctgagctttggcctgcctacctgccagagcaacaacatcctaaacaggggtgagtgggctcttccagtagaggagtggccataaaacaagttggccgggcacggtggcttacgcctgcaatcccagcactttgggaggccgaggcgggtggatcacctgaggtcaggagtttgagaccagtctggctaacacagtgaaaccccgttactactaaaaatacaaaaaattagccaggcatggtggtgtgctcctgtaatcccagctactcaggaggctgaggcaggagaatcacttgaacccaggaagcggaggttgcagtgagccgagattgcatcattgcactccagcttgggcaacaagagtgaaactctatctaaaaaacaaacaacaacaacaacaacaaaaacaaagaagtctttcctctgccccaagggaacaggactgtgggtcactgttagtatttcagtcataactgcaagcaggcagatctttaaatgtgagatacagaactgggcagaaaaaggaaccctcgacaagttacagcattttgaatgagatgaattaggtatttgctttcctggagttggagctggttttaggtattccgtaacataaatatctttgaggtaccacttacacagataataaagcattggtcccccaaaccactgtttatcctctattatattccattaccttctacacaattagaatgagatagaagtacacaaaggaggtgcatccgacatgcatcaggatcacggtgtgggcatcagagggggccttgtgaggcccggagggtgaaccagagtttactgacaattattccgaaggtgatagaacaaagtctggtcttcctctctttaaaaacaataaaacctttcttcgtgagaaatctcaactctggcactagttgaagcatataggctagtttcataaatcaaatggtgcatgttgatttaagatttaagtcatgttgcactgttttctgatatgtgaatacactcaagaaggggtgagacagagcccctgtgtcactgtcccaagaagacttgaatgttttaatatttataatatttttctctaaacttgaaggtcatttgtgtttaatgtaagaaaagctaatgatataattaggttaactaaccctccttgtaaatttgggtttggaagcgatcttgtaaaacaataaataaaattttacaacattctcagttttttatgttaattgtgataagtattttaaacaagtcatatttttaaatgagcaataatataaaaaattaaaaatggttatgttggagtgccaagagtatgcatatttacccccaaggtattttttaatactgttggtttctttttcgtgtagaaaaccaagtctttcccctaaccgtttaaaacccatggtacacgttttaaaatggaggattatgtaaattgcagttatactccttcacttaaaactgttgtgtaatcaaattctcctggtttgtctgtatatagatggagtactgtgagaagagcactttacgagacaccattgaccagggactgtatcgagacaccgtcagactctggaggctttttcgagagattctggatggattagcttatatccatgagaaagtaaactttacaacatttcatatctgaagacttatgtttacataaatttatgactgcataaaaatatcaaatgtaagattggagaaaaactgaaatagagggaaagctatgggtatattgacataatctatttttgtaggaaatagaacaaagtgtcaaagacaataaagtattacaaagtatcagagtataacattaaaaaatgttaagaaaactttaaaggttaggacagggatcagcaaactgtggcccacaggtcaaatctaacccactgcctgttcttgtatggcctgtgagctaataatgactcctatatttttaaatggttgtaaaaaattagaagaacatttcgtgacacataaaaattacatgaaattcaaatgtcagtgctcccaaggttattggaacatagctatgctcattggtttacatattgcctatggctgttttttttccataccagcagatttgagtagttgcaacagggactgtaaagcctaaagtattcactctctggccctttacagaaaaaatttgttaacctctgggagaggagaaagtatttgaacatgtagggaatatgaggatgattccttgagtgctttagaattagggccaggtgcggtggctcatgcctgtaatcccagcactttgggaggtcaagatgggcggatcacttgaggtcaggagttcaagaccagactggtcaacatggtgaaaccccatctctactaaaaatacaaacattagctgagtgtcgtggtgcacacttgtaatcccagctacttgggaggctgaggcaggagaatcacttgaacctgggaggtggaggttgcagtgagctgagattgtaccactgcgctccagcctaggtgacagtaagagacttcatctgaaaaaagagaaaaaaagaattaagcaaggatgtgattaatacctgccaagttacttgattctaactgaattagtgccacccttcctaggaacacggggaaaccagaaggtcatctagcaagaagagaaatgagactttctgagtaacttagcttgtcgcatgtctaaaatgtcattttaaagctagaaattgccattataatataaatgctaatgggcctagcttcaggatgaaacactgcttacatttttaaaatgagattgtctaatgcattaaccaatataaattcattatttttttcctttgcctcaaatttctttaaccttaaaatgtttgtactgtaccgtatttatactgagaagcaagggctgtaatttacacatgtgtagtttgtaaatgatttggtagaagcagaatttgcaaggttagaaatgaaaatgaattctaatgagggccatttaagctgtattactgtgattttatcctgggatgctagaacaatgccccctgtgctctattccactccatccaatttgctcagtattggctaaccatttgctggcatctaacactgtgccatacctggaaatacaaggaggcacaagtgtgtgtcccgtgcttgagagggacttcttgctcttagagggacccagaatttaccttcatgtaatggtaaaagagatcattattttctctattataatgcatgaaacaatacagattatgagccattaggaaaatgagaaagcagtctcatgtaacaagtaattgttgcacacctactgtgtgtgctggggatgccaagttgaactgttagaattactgtggaaggctcatgaatgagttggcaattgcaaatgttggtatagtgcaaatgcatggaaaaaagcgagtatcctacgaaggggagagggtacaaagaaaggaatagaagaaggaataaaaatggtgtgtctccctgaccagaggagaggttttgtaatgcagcagaggtaagggtaacttggtgaacccagtggaaggggccttggatgccacagggaactatttagaattcacctggtcaggataccaccaggtagaactaggaaacagtaaagaggtcataggacagtcaggacatattgcagaggccagacagcctggaccagggtggtctgtgggagaagacctcatacgattttcatcgctaggttggccttttaaattaggaagtaggtataactttatgcatggaaaaccattgtttgtttcttcactctctttcaacagggaatgattcaccgggatttgaagcctgtcaacatttttttggattctgatgaccatgtgaaaataggtgattttggtttggcgacagaccatctagccttttctgtaagtattttaaaaattagactgtacctaaaaacagactcagatgtcttgataatcctggaagtgttagcggatagaatagtgcgttcacagaactatgccgtctaatcctcaggagattatacaaacctgaaggggtatgctgcaaatgatcttgtaggctttgcaattgtgagtatatttttttgagtgcattccacttgagggacacaaaattattggcttgggaacaatattgtggtcaaaggtgtacagtactttatgaaatcatttggtattttggtctaccatgcctggcactgggctagatgctttatacctcagaggcttttgttggtttggggaaatgaggctcaaaaacgtaaaacaccaggagaccatacagttgtaaggctcaagaaaggctggataacgacagtggcatttcagatgtccttaaatggtggttgggagtccaacaggtggaggttgagggcagggcctggtggccccagggtgggaattccagagagagcacagcataagcagaggccccggggtaagcagacttggctgtcggaagaccagcatactgtctgactggtcgaaactgtgaggtgcaggggagagtaagaggatgcggggcagttgaggagtcactggaaggttgggcagtcttgtaggtggtaggctttgaatgccagaggaggaattttgcttcacattataaacccaagttattaagcaccaagatctgtgggaaatgcagttaattccaagggtgatcaggaaaggaaaataggatttgagttaatggtgagaataaccactggggccaagttagaaggtgagactaggagtggaaagggaggagagggaaggcagacagtacggacagggtcccgatcatgctccccatggagtatatgggagagtgctgagaccaaggacgggccagatggtggggatcttgatccccaaactaaagaatttaacttgatatctggaaggctgtagcatagtgagatagataagagctcaggctctggaatctcactgacctggactagaatcctatctctgccactgctttgtagcatgatattggacaattaattaacttctcaatacctcatttgtaaagtgtgcctaatactagtgcctagctgaaaaagttatcaggaagataaataagaatgcaggtaaagcacctagaacagtgcccagcactaagaatgttgaagccggtgttactgatggtgatgcttgtaatgggaagcacctattacaagtgcagacataacaatagtgacttagggtattgacaacactgttgcacatagtggagcaaggtgaggctacctggggggcattagccatgagcgagggtggaacatatttgctgagcagcctctaggaaagaagaataaaaattgatgcagagaaagtaacagcagtgggtaagttgaaagatgaatttgttgtttttaatataatcttactcttcttagaaaacagattctgtttttggcatttgcaacatgaaaataaattggtttctctaagtgtttgcatatttctgtcctaaagaaagagttgtacagtgattgcccccctccctcttgatttcattgggttttctgagagccttgcattagtgggttaactaaactagaaaaaaaattaaaactcaaagcgttattatattattttgatttccatgtaatatttcctcagtcttcatttagaaacagacaagccattctcatggaataatatcatgttttaattggatatttggcttacttatatttttaggctgacagcaaacaagacgatcagacaggagacttgattaagtcagacccttcaggtaaacccagaagactatatatttcatccatgtgttaaagaccccagaatttcttaacctgaaacctgttttttacttgtaaaggttttattctacggcagattttaattgctccttaagttaacaaaattatggaaacgttttaatctttttttccttttcaatttatgaattattctttgaactttaagaaattagagcttcagtgagtagaataattggctcccaggggtagacagttttattttgtctaacctccattggtaatgtgaggttacctcatgacctgatccatctggggtcttatctggcactgtccctcctcttcaatagcaaagacatccttgtgtagaaccgaatgtgtggccatacgtgacttatggttattcatttggtacaatgcatgctctgcttcctgtgagtggcatagacagttaacagatcatgcctcacttttaagaaacctttttttgtttttagtttgtgtcttctgtaagtgctattattgggacgttttccctctgttttcctccacacaggtcacttaactgggatggttggcactgctctctatgtaagcccagaggtccaaggaagcaccaaatctgcatacaaccaggtaagaggttttgtggggaaaaggaatctcaaaattaaggtaataggacatctagatcacagcatttgggatttagtcccggctaaaatagtcaagacatccactcattcacactccaggaaggactcatggtcctaaggatagtgactgaaactggcactgctgctgccaggagcttacagtccatccatccatccatccatccatccatccatccatccatccattcatccatccatccatccatccatccatccacccacccatccacccatccatccacccacccatccatccacctgtccatccacccgtccatccacccatccatccactcgtccatccgtccgtccgtccatccatccatccatccagccatccatccatccatccatccaaagaatgtgcaaaccaacccctatcttgggcaaggtgccaggaacagatgtggctccagccctcagggagcttgtccactggtggatgaaacagacaacaaataagtaaaaaataaaagatatagccacaaattgtggtgagggctaggaagaaaagaaatggaactgagtgacaaagagaacagattgaccagggaagatctcttgagaggatggcatttaggataaaggatgagaaaggacaagccacacagatttgggggctgacacatgccagggagggagatggtaaggagcagaggaaactgcacacataaagagaaagccctgagtgagagagacagcttggcacatttaagacagccaaaaggaaggctagtgtggccacagtgtggcaagcaacaggggacagaggcatgaagttaagctggaaaagaaggcagggaaagatcacacagagccaggttggcctggataaggagtgtgcatttaatttgaagtacacagggagccagtgaagaatcttgagcaagagagttcactctggctgctgcgaggaggctctgcaggaagtcctggtaaggcggttggcagctggaactggactgcaagcagtagaaatggagagaagtgtgctgaattaggaagggaattgagagattttcccaatggaagggatgttggatgagaattaggaagggatttgagagattttcccaacggaaggaatgttggatgagaatgaggaagggaaagagtccagggctcaggtttctttctggaacacctgggtgaagagtatttgactgaagtgaggaaacctaaggacagacataagaggaaggaggagaagatgacagaaaaattcagtttgaggcatgttagtttgaaatatctgatgagaaatccaattagagatttcgagtagattgttagagacccaacacttgagttcagaggaaaggtgagaatcagaaggataaatttgaaatcagcacacagataggatttaaagctatgagactggatgagatcacttagggcaagagtgtaaagctaaactttaaaaacacattaggtgccaggcatggtggttcatgcctataatcccaggactttgggaggctgaagcaggaggattgcctgagctcaggagttcaaaaccagcctgggtaacatagcgagacctcatccctactaaacatcaaaaaaattagccagtcctggtggcacacgtctgtagtcccagctcctcaggaggctgaggtgggaggactgcttgaggccaggagattggggctgcagtgagctgtgatcatgccagtgcactccagcctgggcaacggagcaagaccctgtctgaatcaattatatatgtgtaaaataaaatacattaggaaagcaatttgcatcaaagcaaatgctcaggcttgcagtggagattcaagcctgggttttggttctgacagggagcattggacaacaacataaagttgaaacagacatctaagtacctggtgagggtgagggttagggtatcaggagatggactgcacacactgtgagtgtgggcagacacctttagtgtcattattattattattattattttgagatggagtcttgctcttttcgcccaggctggagcacagcggtgggccatcagctcactgcaacctccgcctcccaggttcaagcaattctcctgcctcagactcccgagtagctgggattacagacgcctgccaccatgcctggctaatttttgtatttttagtagagacagggtttcaccatgttggccaggctggtctcaaactcctgacctcagatgatccacttgcctcagcctcccaaagtgctgggattacaggcatgagccactgcacctggccgtatatacatatttttttaaaaaaccaaagtgggggcatcttagacatcagtaataaatatccctgagtggtgggatcatgagattgctattttattcttggtgcttttgttctatgttttctatagccaacacgtataggaaatgccacagtgaatgtttttaagatgtcggaggtcaccagtgacaatccaagagtctcgccgccccctctttgagtccaaatgtattcaagagtattgcttgaaaatgttttccattgtcctgaaagcggctctacaccctgcacctctgtgcccctgaccatgtgcagtcttttcctcggcagctgtgtcatgctcggtttcctcagatgcactcccttcccaacgccatcttctccttcgtggcaccctacttagattttctctgcactgacttgcctttttgcttcttttttctttttattgtagatactttttttgtttttgtcaattatttaatagttatcttgattatttatatccttctagttttttgactttagtgtttttttctgtagctttttatttttatttattttttatttttttcctagcttatggaggtatgattgatgaaacttgtctatatttagggtgtacaatgtgatgttttgatatatgtttacattgtgaaatgattaccacagcgaagctgaccgacatacccatcacctcacctggtttccattttttgtgtatggtaagaacgcttgagagctactttcttagcaaacctcaagaatacaatgcgttattattaattatagtcaccatgccgtgctttagatctccagaatgtattcattttataactgaaaatgcgtgccctttgaccagcacctccccttgacccccagtccccagcccctggtagccatcattctgttctctgttactgtgggtttgacttttatttagattctacataccagtgagatcatgtagtatttgcctttctgtgtctagcttatttcacctaacataatgtcctgcaggttcatctatgttgtcacaaatggcaagattctcttctttttgaaggccatatgaccctgtagtcaggagctggccttttctatcagccgcagattttggtctgtgtttcacttttaagatggttagctaagatgtgaaacaaagcaaattcttatgatcaatctcagttgtccttgctcttcagccattatttccagttttcagccagtggttttctatgtctgtggatacaactaaaccagttaccattaattttctaggaaggccaggcgtgttggctcatgcctgtaatcccagcactttaggaggccaaggtgggtgaatcacttgagtccaggagttggagaccagcctgggcaacatggcaaaacccactctgtacaaaaaatacacacaaaaaaattagctgggcatggtggtgcacacctgtagtcccagctacttgggaggctgaggtggaaggattgcttgagcccaggaggcagaggttgcagtgagccgagactgcaccactgcacttcagcctgggtgacagagtgagactctgcctcaaaaaagaaaaaaaatttctaggaaaatgtttaaagacatcatgccaaatattttatcatcatctgaatacaaaatatatcatttagcctttataaccataatttttaagaacaaatcttcgcatttttccagtgtgacctgttttgtactcctacaaactttatttcagctaacaatgcttatcctataattccctggtaaattatactttcatatcaaggctctctaaatgcaattattcttccccctcagaaagtggatctcttcagcctgggaattatcttctttgagatgtcctatcaccccatggtcacggcttcagaaaggatctttgttctcaaccaactcagagatgtatgtatcaggtgttttagtgcctacattttcagtaaccggaatcttagcacagagatcagaattcaaagcaggatatttttctggtatttataatatagaagaggctgccctactgtaattttaatgactcatttattcagatatgcaagactaaccagttttcccatttttagtgaaacatttttctgagcaaaggaagtcacctcagttaaattcttaaaatagcagttttgggagccaaagatcatcagcatgtaggagggatcttactggtctctccactatgtttccacagtgaggtaaatggaaccctacctctgatgatgggaaacttgccccagttttgtttgtttttggaaatcttacctggagaaattgctaggttatagttgctttttaaaaaattattctgagatttactcttgattttaaagcaaaggaagaagccacaaaattgggcttgatatgaatatggttataacaagggagtagattgtaaagaaatgggtatttagttctagaagttaaagatgcctgttgaatgggccagttgtagtaacgtctaaagaaaactaccaagaccagaagttaaaacgggtccgaaaaaaatatctgccccttgaaatgtttttcccaatgaaatttccatttgtgttcttgggattaatccttgcctcatttactgcctgagctaaaaagggaccagtgttacatgtgcgaggtcagagatgcccatgagcaaaccgcattaagatgaaagtgaagagtgaggtttgggtgagagtgatttaaattcacatatttatgagcgagacatctggagagccaccttctttcttactgagcagagtgaagcaggaatatttattaagttaattcataaacacgataactagaatgcagtaagaatactcctgtattccactataagaacacttctctggataattttgaaaacaaattattttactgtgagtacagtgtggacagctgtgttcgtaaagtataggactaagtgaagtgatttctattgcctcgccttgactgcaatgctcttagatgattatgtccttaatgaagtgcctttctttagtctaaaattcatgtttatttaccagaaaggtgagaacttttggggaagtagagattttttttctcttactctatctgtgttggtatatgggtgtggttttttttttttgttttgtttttttttgccttttttcatctgcatgtttaattaaactactttgttgttctctgaagccattaggtttttactttgtacccagatgtgctttctgccccttgaaatttttttctcagtgaaatttccatttatgtttttggggttagtccttgcctctgttactgcctgagctaaaagggaccaatgttatagtatgtgaggtcaaaggtgcagacagcattaggacgaaagtgaagagtgaggtttgggtgaggctgtcatttgggtaaagtttatattaaaataatatgtatgtaattggaagaataagcgtcaggtttcaagaaggtatcacctatcttttcttgctagcaaatttttatttctgtatttgattttcttacttatggtgaataaatgctttcactgtggcagtctgccaaaaccttgctgatttgaatatatttttttagcccacttcgcctaagtttccagaagactttgacgatggagagcatgcaaagcaggtaattttctgatgcgtcaattactatgtcttcagtcttgcattttaattattatttttcttctttttcaattagtaatcttctgccactcattctcttgtgtcctgggaacaacgtggggaaaaaatatgaaaagatgaagcacttaaaatgtcattagacttgaactacaccataaaaatgccaagggctggcacagaaaattaacaaactgcagggttcttttgtgcaattcgttgtgcttttgaagtgctatttggacccttggcttagctgttgaaaaaaaaaaagaatccttttacaactcattgtttttgataaagcttggggctttaagaaaaaaatataatttaaaactgtaattttgttctgttttgtggttgcagtagctcagattatgggggaagggttgcattttctggacagtctattgtcacagtattttaaagcaaaataaattctcctatataccataaatatctgagtatatgtgtgtgtgactcatgacataggctaatattggcatccagcaaatattaaaaaaaatattattggtgaatgtgtgtattgggcttctggtatgcctttcttctgagtgccagttgtttgtcttggtacagtggttaatactcttgtcatatggaagtttctcaaactgacttactgacaattataatcaaggcaaactccttatttaaatcattaatgttgagaacaaaagcatagatggaatattgtattaatttggtccttcttgcttgctggttatgtatctgaatggacatgccacttttctagactttaatttccctcacctataaaataaaaagattaagtactctttatttatattagcactaacattgtgtcatttggtaagtttaacatgatggttatttatggctgtagggacctattctgcctcatctgtttaattagtgaaggccattagaaatacattgagtcatgtttctgcttcttttggtagctattattgtttctgggtgtcataagtaaacattcatttcatagcctttccttatgacaaggtcagtcttatttggtgtttccccttgttgacagctaagatggcccaggaactatacaaaccatttttcaccatgaggactgcactcctaccatcagatatatattagatacccttgagcatttgagtctgggctgtacaaattggcaccaaaacaaaaacaacaaaaccacaaccacctcccatgtcatagtcattgctttttagctgaaaggaggaaacttagaagatgcttatagaatgagcatagcataattttttgccatgcacatttaccagtacagcagggtctattatgctcaatagggtattcttgtttttgtcagtttaatatacctttcataaaagttgtatcatgtcattttctttctatataatactcctatatcccatacaaactaattgcctgtgtttttattttaccctaatactggaaggagagtggtaggggggcatattttaaagatttataactagaaaatgcttaataaagtccatctaataattgaggttttcttatctcaaatatttctctaactccttataaatctttattataaacaagaggattaaacatcattaaggaacctctcaaaggtttagattgccttcatatggttcactgctttaatgaggtggctgtgaagatataacaaatcagtaacataaatcaagagaattcaagggaatggtatcaatgcaaataacataaatggagaagaaaccattaaaacaagatgttttacattgcttttaggattccagcagttattatgcattacaatttctactaaaattaggcatgtaaagctatttgttttatctttttacatctttttatacgatattttctgtgtttataaggcctaatttctgcttctatgtagttgttgatttgattttttttggttgtgacaataaggtataaaaacaaggggcctccttttaagaaatgttcatactacattgttgcacaactctgtggtcataataaagcagaaaaaataatgacctattcagaaatttcagaatgtcagttaagtgcaagaatagtggcaccttttctttgacctgaactgactactgacttgtccggagaatagctgagcattatccattgcatcccattagcagtgtgcctgggttttattgtagaaatcagtcatctcctggctgttgaaccacgatccagcaaaacggcccacagccacagaactgctcaagagtgagctgctgcccccaccccagatggaggagtcagagctgcatgaagtgctgcaccacacgctgaccaacgtggatgggaaggcctaccgcaccatgatggcccagatcttctcgcagcgcatctcccctgccatcgattacacctatgacagcgacatactgaaggtgggcttaagccacgctgcacaaagggagcttcaccttgtccacaaaaggatcaagccagtttctcacagattcttttaatgcctctaacataagttcttatgtgaggtattggaagcccctaaaagtacatgcaaaatgtgtgtatatgcattcagggaagaggacccatactttcagtcacctacttgaaggagtccttgacctttcctcctccctacccacccaagagattaagaagcagtgcctacaaaaattagccgtgcgtggtggcatgcacctgtaatcccagctacccgggaggctgaggcaggagaatcgcttgagcctgggaggcaggcggaggttgcagagagccgagatcgtgccactgcactccagcctgggagacagagcaagaccccaactcaaaaaaaaaaaaaaaaaagaaacagtgcatttagagactgatccctagcccaaacgcccagagccataagcatcaaccagctcatatctagatgaagtataaagtagttcccagtgctggttgcacatctacttcatctcagaaactctctgacaatgcagatgcccaggtcccgtagcccatctagtggctcagaatctccaggtgtgaggcatttcagaatctcattaaaagctcccaagcagtttctgaagtgtagccaggttgccagtttgggaagactttaacatttaatttcttttaaaaagaaaaaaaatctgaagcatattagtgaaatgttaaaatgtgttaaagttgggtgagtaggtaacaggtatttgttatattctctattatgtttctgtttgcttaatatatatgatataatttaaaaagatagagtagtggaggaagtcatagtaaaatttatgaaagatcagtatagattttagagaccaaacacaatttttactggctggcaatattattatagaaagatatttgcaggattataggtgacttttttatagatgtcttttttcatatgtgttgtttctaaattttctatagtgaaatggtactacttttataatacaaaaacaaatgaaaaagaaagctattggcaaaatatgtaaatgccatgtagctttcaacaggcctgccatgaatcaccttggtatgtgggaggggcctgatgctgttaggtggtcatcgcgccacagtatccctgagagtcagagagaatgtgtttatttgattatctccctctgaaaggcaaatatcaatgtggccaagaatttggactttgaacccaggcatccttcccattggttgaaaggttagctcttgctttccaaagcaggccatgaaagatatgtgtcctcttccctgatgtgttcaaagagggatggacttgtcaagacttgttttttgaacctggaaataagcagtgtagtgcctactgcaagccacagattaatattttaaaggatccctttgataaggcttcaatgatgatgttttaatcggtcctgttttagggcaacttctcaatccgtacagccaagatgcagcagcatgtgtgtgaaaccatcatccgcatctttaaaagacatggtatgtacgccctttttaaaaatgatatttcttctcataagacttttttcatcattagaaagtactgttagtgttcgggcatatcatattttactttcaaattcagttataaataattgacatcatatggaatttaagcttatttttgaaactgatttgaatattacagccttactattaatactaaaatgcaattggtttgtggagtcagaaatatgaccaaactgtcaaacttaactctagatgagctctctatttataaatttagagaactcaagaaaaattgatatgacttcaatggtcccagtagcaattacttaactgtcaggtttgtgttaattttaggttgccttctaaggagaatgtgaacctgatgatgagctattttttctcatttggtgtaggagctgttcagttgtgtactccactactgcttccccgaaacagacaaatatatgagcacaacgaagctgccctattcatggaccacagcgggatgctggtgatgcttccttttgacctgcgggtgaggctgggaacacactgctgacaatcagaatgctgtatctagtcacagggatggcatctctgttaaaggatttttcccccaggcttatattataaatgtcacctttgggaaatgtattcttgaggaagttgtcagagtgagagtgttactggggtggaggaaatgtttggtcctgaatgcctccaccttcctaatagctcaggtgtttatggctctaggaactggaggaaccctgcattgcaggtgccacatgtgcaccccccagtgttgagtgaccacagcaggttaaccccacccacttagacaaataaatgtagtttgtttgtctttttaacttcctggctagatcttcagtaaacatcctaacatgttaatgcctagaacagttaaattcttctaacagcaagtgtctctcctaattgggtatgctgagttttgcccgtgcctgctttcttccgacccccagggatcctgtcgacagcagcagtcttaactagtctttcactcacacagtgttggctactaacaagctatctgtggtgctgtatgatagagcaaggaaaacatgcaatgcatgtgacagacaaggtttaatacctctcacatacagaaagcactgacaagtggagacatgagcaaaggatataaccaggcagctctcagaagagaatatgtgcatggctgataaacttctgaaaagctgtactgcctcaccaataataaagaagtgcaaagctgtctcaacttcacccatcagacaggaaacatttttaaattaatgttatccagagatgacaggagtgtaggaaagtaggtattttcatatgttgctgatgggaatgtggactgctaaacctttagaaaagtaatctaaaagtttataataaaactttaaaaattttgttgcacattctttatccttagaaccagcaatcccactttgagcaatttactcaaagaaagaaaaacacatcagtgtatgaatgttaaaaggatgttaattgccatattattgtggtagtcaaaaactgtctgtctgtttatcagtaggaaaatggttgaataatttgtcaccaatattatggaatattaaggagctattgaaaagaacattgagctaggcacagtggctcatgcctgtaattccagaactaggctaggtaggaggagtgcttgagcccagtagttcaagaccagcctgggcaacataggaagaccccatctttacaaaaaatttaaaaattagcccagtgtggtggctcgtgcctgtggtctcagctacttgggaggttaaggcaggaggattggttgagcccaggaagtcaaggcttcagtgagccatgattctgccactgcactccagcctaggaaacagggcaagactctgtctcaaaaagaaaatttaaaaatttttttttgtagaaacgggctctcgctgtgttgcccaggctggtctcaaactgctggactcaagcagatccttctgcctcagcctcccaaaatactggaattacaggcatgagccgccatgcccagccaatctatatttttatatagatcaaatatgtattttttatatatgtataagatgaaaatacagtcagctcttcgtacatatccttggattccacatccacgtatccagccaactgtggatggaaaatactcagaaaaaaaaattccaacaagcaaaatttgaatttaccatgtgctaaacactgcattgaatccacacaaaagaagggatgtataggcatagtagtagatattataagtaatctaaagatgatttaaagtgtacaggaggatgcgcataggctataggcaaatgctctgtcattttatatcaggaacttaaccatccactgattttggtatccttgggggagtcccggaaccaatttctgagggacaactatacatatttagatatagccatatttatacttgatttgtaggaatgtgcatggcacattgttagctttttttaaaaagtaaatttcaaaggaactctattatcccatttttattatagagaaagaaaagtttttttaaaaaaattgtgtgtgtacaggaggctgaggcaggagaatcacttgaacccgggaggcggaggttgcagtgagctgagattgcaccactgcactccagcctggacaacagagcaagaccctgtctgaaaaacaacaacaacaaaacaaaaaaacaaaaaactgtacataaggtatactgtgtgtgtctgcatgtacttttttgttttatttttttttttgagatggagtctcactctgtctctcaggctggagggcagtggcgtgatttcagctcactgcaagctccgcctcccgggttcacgccattctcctgcctcaccctcccgagtagctgggactgtaggtgcccgctaccatgcccggctaattttttgtatttttagtagagacagtgtttcactgtattagcaaggatggtcttgatctcctgacctcgtgatccgcccacctgggcctcccagagtgctgggattacaggcgtgagccaccgcacccggcctgcatacacttgatatatgtgtagatatatatatttggccctctacatccttgggtggtttctgtatccatggatccaaccgaggatggaagatactcagaaaaaaaaaaaaaattcacaaagctccaaaaagcaaaacttgaacttgtcacattcacgtgtctgaatgaccgtgcacatcaggttgtttgtatcaccaaagagtaaggtgtcaaagaatacactcattttgaccatactttttggaggggggagtggaatctttttttaaatgtatgtcatatggcttattgtgaaacaggttttgtgtttatagtctaagaagaaattccttccacattcctcacttctgtttttcttttatagtgagtaaagtgatgtgggattattctgaggtagaggtaaataaacagcaaatcagatgagacatttgcgttttgttgaaaaaaaaagaatagaagtacaaatatttacatagctatacttaaagctggcttcttattctctaaatattaggagactaaagtgcagatttttaaatatcagctcccattctataagctgatattgaaatgcaaaaaattaaaaagtgaatgtatgttgagaatttggcccatcagtggtaatgataccatgttggatctgttggggcaatctaacaatggttttactagttgtggttactatttgaaggtgtttattaagaatttattctaagagattgataggaaaatcaggaaattcaccataagagataatacccattttgactgcattactataaaagtgacattttttttaaattcataaataaataacttgcactaattttagttggacataataaaagctccacagagaatatttaactaaaagtgaattttaaaaaaaacctaagaaatgccacagtgaataaggttgatggtatgtctagcagcggagtccaccactgaccaaaacactgaagaacatttcagggagtgtgagtggtgagcagtgcataacttagtgaatacactaaaagccactgaagtacatactttaaaggggtgaactttatgggacaggagttatgtttcaataaagccgctattaacaaaaggcacattttgacattgacctttcatattttgtttatttttcagatcccttttgcaagatatgtggcaagaaataatatattgaatttaaaacggtaagaaacaataggagattccatttggtagacataggaaaatagttgaataatttgtcaaccaggaaagaatattttatttcctgtgatccttacacagttaagaattctgggttcagaatattgagcttagaatatgaaccagaagcccagccacagtaccccttcctgtaaggtaactaggactgttagaaggaatgtagcaggtaggtaccgtcatgttcccacagtctattctgtaccttctaaatgtccccaagcaacattactaattattttcacaaacggttgcttgataaaaacatctggctgttcatgatcacagatggccccttttaaaacttaattggtgggacaaatggccagtggtctctatgtgaaaactgcctacacaggtaaccgaacaaaagctgcttgtagagaagtggagtaaacccagcaggaacgctgagcgctgaggacctccaggcacttagccctggaaaaaggctttctgtacattcaaataccacaggggtccaacactgagatcttcataatttggagcagtattgttgtcaatgaggcaccctactttaaagctcctttcttcaactgaaagcaaagctctttacatgcttttattctagctacaagtgaataattaataatcgtagtcctatggtgtgggtatccctgtgtagaaagcaatcactaaggtaaaattttttggtgtaatttcatctctatttcagacatttaaaaaaccttaagccccatagcttaatagtggcaaaactgggaattggaacctagatcacaaggcaaggctgttccaggtcaaatttgtctttcagtcctcttgatcataccaccgattaattttttttcatatttgtttcttatatcttgttcaacaatttcttatacatatttctttctagtaagcaatgaccttagaaatctgggtttctctctccagatactgcatagaacgtgtgttcaggccgcgcaagttagatcgatttcatcccaaagaacttctggagtgtgcatttgatattgtcacttctaccaccaacagctttctgcccactgctgaaattatctacactatctatgaaatcatccaagagtttccagcacttcaggttcctttccatattttaacattccaagattccccactatatttcttcaccaagtgtggtggggaaaaccacagctacagacctgcttctcagtctgtcctgcagatgaatcacatctttactaaagtaactgagaagagcttgctggtgttgcttttgaggttcagctcaggctcttaccttcacaggaactggttttgttttgggggatgggtattctctgcccattcttctaaaatgcaagatatcaggctaagattcctaagatgctcttagcctgttcataccctgtttggaaccctcagtggctctatcctacacccgatctcttcactccccaacttcccttttcaccaagtctgcatgctgcctagctggtggggactgctgccagcacttctcaggcttccctccccaccccacacacacaccctgtcattcctgccaccgtcagtcaaatgttcccttgtctagaaagtctttgcccagccatggtttgggccctttctccccaggaagcctcactgcaccctcattaattagttggccaccttttcttctcaactctcacaggtcttgatctgagacacccatgtactaccttgagttatgttcattgttttctccaagcagaacatgtgtttttagggcagagcctacgagtccgctttgccatatacccccattgcagccagctcggcacatggctcaccactcggtgaatactcattaatcgatttgtgtggacaaaagttaacaataactattccactggcctgtgcttatgagtcgattactactggaccagatccttctgtctttgaaatcaactctctcgggctttttaacatagctgaagaccagtcagagttgtttttgttttgttttgttttgttttgttttgttttgttttggagacagtgtctcgctctgtctcccaggatggtgtgcagtgatactatcacagctcactagcccctaccttccaggctcaagcagtcctcctgccttgctgcttgaatagctgggtctacaagcatgtgccactgaccccagctaattttttatttttttgtagagatggggtttccctatgttccccaggctggtcttgaactcttgagctcaagggatcctccaaccttggcctcccaaaatgcttgaattacacaggcatgagccaccaccccagccagtctgagtactttggatatatataatatagtattaaattagagtatactctgactataacagtgcaaaaagaatgtatgaaaaaaaaataaactaggaagccatatgctaaattcaatccttccattgtgttaggatgacaaattggtggtaagtttccagatttggtcatgtaccagtaattgcttttataatgaaaatagtaatttttctccatatcccaggaaagaaattacagtatttatttgaaccataccatgttattgaaagcaatactcttacactgtgggatcccagaagataaactcagtcaagtctacattattctgtatgatgctgtggtaagcatttaattacttatgatgttgaaagataataccttgatgttgaaagataataataatagttcctgatgattttcttacccatgcagccatgaaactgaattgggagccttatctccttccttcattgctctaaattgaaagaaccaattgattttaattatatcaacagttaacaagtattggttgagcttttgttccatcctcagccctgtactactaataacctccggggtgttttttaaaaggctaacttctaattttaaaagatcaaattatttaatttgtcagatagtaaagttattcaccaacctacttattaaggcaaatcactaagtaattggtcctgatacttgccaataataatttcaaagatagttaacattgactgagccccgctctgtgagctaggcattgttctgagctcctctgatggatgaactcacttcattctcacaccagtgctgctattacctttcctttagagaccgagagcaactgttcatgttgagaataaacagtgtgccttgcccttgattcttccagtctgcctgtgcttatcagtaaagtcatgtatagatttgcattgattgaattaaggcagaatggcttcgaactctggtggggcctcatttaccacctccttcctgtgggactgaggctatggcacctccagttactcttccctaatttagtcacatcatagtattcattactttatagtatatgtgcgggtacagagactggaaggggacgcattgaaaaaatgaattagtgttatattatgatgctaagatggaagtgaatgcttatgttttctaatatcttttcatgttaagttttgttttcataatgaataagaggcatccaggagatgtaagaactaacagcaccagaagtctatggttaagacagagtagtggaagtcctcacataatggcttattgtttttatacaccaaaaggattaactagcttttctttcatctggcaggtacacatcaatggcccaaactttactgcttgtttcttagtggttctttactccccctaaagctctgctgctgtttgtcagtgacagatacaatatgatgtcaatcggacactggcagaaaccccagggattgtgcaaggggcttcagctcttactgattcatgtcctgcggctacggcacatctgccagcgtgggatgaaatgcccagagcctggcctttgttaggggagcccagagcaaaatgactccctccctgcccaaacaaatgccctcattaagcctgtccagatttgggtcacctcaccattcagcaagtacaactttccccttttaattcttttgtcagggtttttcagattttaaaataagttaattacggttttgtgtgaattgggagaaaaaattttttaatcacagaattcaatctatcctgtaccattaggagcagtttgttcaaaatgaaggctatacttgttagaattcgcctggaaattgtgtcttgttcagtgccagatttcgcgactctcattgttacctttttcttccacgttagacagagaagctgacgaggagagaagtggaagctaaattttgtaatctgtctttgtcttctaatagtgtaagtaccttctaatggtattattacagctttctctgtaattttgtgataccagaaaatgtcatcaaattctcgttgcagtagggtagcagccagcgcttcctaccacctcgcagatgcagtttttcccttgagtgttaggtaccatggcaacctctgggattaggagaagggagaaactaatgctgtgatcaaagaatgtctctccatgcttcttcttgatacgctgtaatcatcctgctctttcttgatcagcagatacttttctttgtcaccccttatagagctgtgcctggtagagcctcctgctgaacatacctaataccagttgtcctcttttgaattagattatacaggactagaaggaggcacagaattctgcaaattcatctggggagctacccttcccctacctccatgtcttctaactcctcagagttgaattaaagctctagcttttctggtatatctcttaatcttaaaatcttacatttgatcccatcatcaataagggaaatcttatggaataaacagtttggtcatattctctctgtaggcatcagattgatcccagatctttggtacagtaacccacacttaattgagtagctgaacaacagaatacaacagggattttgtacattttcctgaatatttaaataaggaaagtttttttttaatttcccggaacctgtctaggcccttgtctgacactcaattatatgatcttgcattgatcagcaaaattcacatatgggatagattaaaatatgattgtacacagggcaggaagagtcactcaatctttcggacacctacagtgtggcaggcacaatggcagggatataaagaagagtccatagactgcattcagcttcttggttcatattggcctttaaaaagccataaggggatatgcacagcatgtatctgccctcaactctgtaaaacagctttcagagggcacacggaaaccagagttcaaagaaatcacccctttgcgggtagggaaagtaaaccagatgcatagcactaggagttctgaaaattgagccaggttaaatcttaaatatttaatattgggggagatagtaatgatatgcaaagtaacacaacagctaaatatccaaatatgaaggacaatatacagtatttacatataatctaaacatgtacacagcacacacctatgtgcagaaatagtcccatgtgtaaatagcacagagaatctgcacaagactgctcagttcaatgattctatacccaagtttccaacccaaaaggttatttggactaaagtcacatttcagaacatctttttttttttttaagaaagtcttataaatatacattcggacgtaatagccacattggttgttcacatgtcaacttcttttctttctgttaaatctctaaccactggttattcgatgatgctaagtgttaattagacgtgtctgattcagttaaaaacagaaaaatagtatctaataaaggcatttggtactttgattattttaaaatggactctaagggtattaggaaggggagtagaaatattgccaaagagtttcacatatctgacccagtcctcttatttcacaaatgagacacctgaggcccaaagagatgttgtgatttgtcctgagtcacatggagttagttgatgatagggtgaggaccaaaatctggagatattgacttcagtgcttctggtagtttattattggggtaatttaatgttcaaatttatagagaagaaatcatttttattttcttaaaaaaatattttaaatcgaatacatgattttaaatttaaatttttttctttttatttttttgagacagggtcttgcactgtcacgcaggctagattacagtggcacaatcatagttcactgtaacctcaagctcttgggctcaagagatctttctgcctcagcctcccacttaatttttttttcttttttatagcgggatagcaggcgtgagccattgcatccagccaaaatttttatctttaatccctctattagtctgctgtcacactgctaataaagatatatccgagagtgggtaatttataaaggaaagaggtttaatggattcacagttccacatggctggggaggcctcacaatcatggcagaaggcacggaggagcaagtcacgtcttatatggatggcagaaggcaaggaggagcaagtcacatcttatatggatggcagaaggcaaagagagagaacttgtgcagaggaactcctctttataaaaccatcagatctcgtgagacttattcattatcacaagaccagcatgggaaggacccgcccccacgattcaattacctcccactgggtccctcccatgacacaggggaattgtgggagctacagttcaagatgaaatttgcatggggacacagctaaaccatatcattctacccatggcccctcccaaatttcatgtcctcacatctcaaaaccaatcatgccttcctgacagtcccccacagtcttaactcatttcagcattaactcaaaagtccacagtccaaagtctcatctgaaacaaggcaagtcccttccgcctatgagcctgtaaaatcaaaaacaagtgagttacttcctggatacaatgagagtacaggcattggataaatacacccattccaaatgggagaaattggccaaaacaaaggggctaaaggccccatgcaagtctagaatccagcagggcagtcaaatctgaaagctccaaaatgatctcctttgactccatgtctcacacccaggtgatgctgatgccaggggtaggctcccatggccttgggcagctccccacctgtggctttgcagggtacagcctccctcctggatgcttccatggactagcatttagtagggactctgtatgggggctgcaaacccacatttcccttctgcactgccctagcagaggttctccataagagccccacccctgcagcaaacttctgcctgggcatccaggcgtttccatacatcctctgtaatctaggcggaggttcccaaacctcaattcttgttttccgtgcatctgcaggctcaacagcacatggaagctgccaaagcttggggcttgaaccctctgaagcaacagcctgagctgtacataccttggccccctttagccatgggtggagcagcttagacacagggcaccaagtccctaagctacatagaggaggggggccctggggccagcccacgaaaccattttttcctcctaggcctccaggcctgtgatgggagggcctgccatgaagacctctgacatgccctggagacattttccccattgttttggtgattaacacttggctccttgttacttatgcaaatttctgccgctggcttgaatttttcctcagagaatggggttttctttcctgtctcattgtcaggctgcaaattttctgaatttttatgctctgttttccttttaaaactgaatggtcttaacagcacccaagtcacctcttgatgctttgttgcttagaaatttattctgccaggtacccaaaatcatctccctcaagttcaaagtttcacaaatctctagggcaggggcaaaattctgccagtctctttgctaaaacatagcaagaatcacctttacttcagttcccaacaagttcctcatctccatctgagaccacctcagcctggatttcattgaccacatcattatcagcattttggtcaaagccattcaacaagtctctaggaagttccaaactttcccccattttcctgtcttcttctgagccctccaaactgttccaacctctgcctgttacccagttccaaagtcacttccacatttttgggtatctttacagcccaactctaccggtaccaatttactgtattagtttgttctcgtgctgctaataaagacatacacgaaactgcgtaatttataaaggaaagaggtttaatgaactcacagttctctgtggctgaggaggcctcacaatcatggtggaaagcaaagaggaacaagtcatgtcttacatggttggcagcaggcaaagagagagaacttgtgcagggaaactcctctttataaaaccatcagatcttgtgagacttattcactatcatgagactatcatgggaaggacccgcccacatgattcagttacctcccactggatccctcccatgacacatgggaattgtaggagctacaattcaagatgagatttgagtagggacacagccaaaccatatcaagattataggaggttttaacattttttgggttttttaaaaatttaagtgatttatgattaactctaagattaagctatgtcaatctgagccttcatttagcccttaggtttcatgtgccaatttatggatgaactaggttgtacttgcctacagtcttaaaatggctataattttgtttcttaataatttctactttagctcctgggagttttctttctggctttatgactatggttgtttcctcttactccagctgagtaccagggactgtgagatcaatcatctctagccactgacctcttctggggcagtctatgagtacagctggtgacagccaggatctggcatccaggtgggaggagagggaagggaggatcaggaggctgcccacaggagaagacatctcaaggttgcaaataggaatgattcaagccaaggaagggaatttctagctaattctgtattaaaacaagtcagactttgccttattgtccccccatgtctatgcctgcagtaacaggaattcatgagaataagaaaggtaaagaggaaaaatactggcctgaaaatagataatggaagctctgctagtgccagggtctgctttgctggggtcagcattaagtgtgagtaaatgtatctgaataaaagtgaaccatgagtatgtgtctaaagcattcctgcaaggtgctttcaagttgttggaaaaggataatccttagtcaggattgtggcaaagcctaaaataatctttgaccacaaagataatcgtagcatcccatgtgctcctgctcctgcaggtgcacacagtcggtgcaaagggagtcttcccctgctgtggatgggcagctgactgtgcccctttgctttccagctgtgtcgactctacaagtttattgaacagaagggagatttgcaagatcttatgccaacaataaattcattaataaaacagaaaacaggtattgcacagttggtgaagtatggcttaaaagacctagaggaggttgttggactgttgaagaaactcggcatcaagttacaggtttggcaacagtttgatactggcagtacaaatgtgtagcattactaatagcacagggaggaaatgtgtttcatttcactaatgctagttagtgttttatttttccagaaaaactgctttctgtgttttggagcatttgatatttagtaataattttggcttaaatcaggatttctttgcaagtgccactgttcctatcatgaagcagttcttactatgttagcctcagagaggtggttattcttaaagagaagagaatttattttacttgtcaggctatggttaaacagactttgagctagatcttactgaatattttgtttatgctaaatagattgttctgatgctattgatgggaaacaccattttcagcattatattccacattctaaatttcaaacccttgacacatttgtgtggcatctctctttataggtcttgatcaatttgggcttggtttacaaggtgcagcagcacaatggaatcatcttccagtttgtggctttcatcaaacgaaggcaaagggctgtacctgaaatcctcgcagctggaggcagatatgacctgctggtgagggcttgccctttatttatttgctctgacttaattttatttcttctaaacttgttattttgaaattttcaaactaacaccaaaaatttgaaccagtaatatcattggatacttctattaatatatgtttcatctaggaatagaaatataatgtgaaccacatttgtagttgtttaagcttaaaacaattatattattttgcaagatagttgcaaagatagtactgagagggctcatgtaccctttactctgtttctatatatatatatatatatatatatatatatatatatatatatatatatatatgtattttggagacagggccttgctctgtcacccaggctggagtgcaatggcgcaatcttggctcacagcagcctcgacctccctgggctcaaatgattctctcaccttagcctcccgagtagctgagactacaggcatgcaccaccacacccagctaattttttgtattttcagtagagacagggttttgccatgttgcccaggctggtctcaaactcctgagctcaagcaatccacccacctcagcctctcagagtgctgggattataggtgtgagccaccacaccaccccttgcataagtacagtaaaatatcaaaaccagaaaattgacatttgtataatgtatgtgcatcattcttctccattttatcacgtgtactttccctcaacaaccaccataatcaaggtacagaactattccatcaccacagagatttatgggtatcaacatcttatcaattcaaatgaaatgtagaaactttatctccctgtatgtctctttacctcatgccccatttataatataattgtcttaaatatttcttctaatacattgagatccacatcaaacagtgttaaattttttactttactgttaaatataattataaaactcaaggggagaagaaggtctattgtatttaccccaaatttctggtttgtgatgagaaatttgctgttatttgagttacttttcccctataggaaagttatttctgacttgatgctttaaagattattttctttgtctttagtttcaaattaaatcatgatgtgtcttggcatgagtttctttggatttatcctgtttagggtttgcttagcttcttaaatctataggtttatgtcttttgcgaatttggaggattttttcaggcattctttgattttttttttcagtctcacactcttttttctctccttctatgaccccagtgacacaaatgtccttgaggttatgggacatttttgtccaggctgatctcacactcctggctgcaagcaatcctcctgccttggcctttcaaagcactgggattgcgggtgtgagccaccacacctgacctgtaattttaaattatttagtaacattaagtaaaaggagacaagtggtattaattttataatatatcttatttaacttagtatatccaaaatattatttcaacatgtactcaaacttctaaaaattattaacaaggattttacatttttttcaaagtctttgcagccagtatgtgttttacatgtacagcatgtgtcaatttggattagccatatttcaaatactcagtagtcacttgtgactagtggctgccatattgaacagtgcagagttagatgaaacatttgttaatattttttctaaatttgcatgtgtgcttgcttctctattttactacacacacacatttctttttgttgaactctttgatgatgagctgctgacagagtgctcactctttaatcattgttttccccgtaatcacagtttctttcctatttcataaccataactgtttgtgtctctccacagattccccagtttagagggccacaagctctggggccagttcccactgccattggggtcagcatagctatagacaagatatctgctgctgtcctcaacatggaggaatctgtaagttctggcttggcttcccagcatacttcgaggtgtctttcatttctaaaagtatgatttgccttttgcagtcatttacatggggcttctgatgtgaaagctatagacgtagggttttgaaacttacctttaatatgatagacaagcctaagacttgatgtcaatccctgcatttcagtccttatcatctgttctctagctggacgaccttagaccaggggtccctaacccccaggcagtggactggtacccatccagggcctgttacgaaccgggccgcacagcaggaggtgagcagtgggcaagcaagcattaccacctgagctccacctcctgtcagatcagcggtggcattagattctataggagcatgaaccttgttgtggactgcacatggaagggatctagactgcacgctccttaggagaatctaactaatgcctgatgatccgagatggaatagtttcattccaaaagcatcccctcccaacccccgcaccatccatgaaaaattttcttccatgaaaccagtccctggtgccaaaaaggttgaagacttctgccttagacaattaattcatccttccctagactcattttccttatctgtaacgtaccatataaatgtgagatgttatagttgttaacaggctcttaacaaaacttcttgttcaggccaggcatggtggctcatgcctataatcccagcactttggaaggtcgaggcaggcagatcgttgagcccaggagttcaagactagcctgggcaacatagcaaaaccccatctctaccaaaaaaatacaaaaattagctgggtgtggttaattagccatgcacctgtagttccagctactcaggaggctgaggtgggagaatcgtttgaacccaggagggggaggttgcagtgaggtgaaatcatgccacttccactccagcttgggcaacagagccagaccctgtcaaaaaaaaaaaaagaaaaaagaaaagaaaagaaatcctgctgtggtctacaaagctagaaatagctttttttcccccttgtatttcaggcaagattagttttcctagagaaaaatggtattttccagatggctcagggtagttgaaataatttctgtcttgaaagactaacataacattttttttttttttactgtggccgagcatggtggctcatgcctgtaattccagctatatcccaataaggccaaggcaggtggatcacttgaggccagaagttcgagaccagcctggccaacaagcagaacaacatccctactaaaaagaccaaatatatatatgtatatatatttatttatttatttatttatttattttagccgggcatggtggtgcacgcctgtaatccagctactctggaggctgaggcaggagaatggcttaaacacaggaggcggaggttacagtgagcggagatcgtgccactgtactccagcctgggtgacagagtgagactctgtctcagaaaaaaaaagaaaaagttgtttgagtgtgtcttttttttttttttttacaatgtgttttgaagcaaagtctttggcacgctgtgtttctatgcaggatttcaagaatgcccatcttcccaagagtgctgcctcccctcctgatgctggtttcacttccatgcctgcagtcttgctcctctaactgtaaccggtctgtttctgatccaggttacaataagctcttgtgacctcctggttgtaagtgttggccagatgtctatgtccagggccatcaacctaacccagaaactctggacagcaggcatcacagcagaaatcatgtacgactggtcacaggtaatgggacaaaaagcacctgtgagtgaagtgcaaattgctatggctttcatggcaaatatcctctgcacctatagactgtcaaactctgtttatctctgtaattcgagttgcctcctgtgttagtttctgattgctgcagtaaccaattaccacaaacttactggcttaaacacatatttattatcttacatttctggaagtcagaaatccaaaagcactttcactgggttaaattcaacagggctggctcctctgggaagctctaggggagaatctgtgtccttcccttttctggctcctagaggcctcctgcattccttggctcatggcctcttcctccatcatcacactcagcaatgaagcgcctccttccttgctgacctgtgcttctgttcttacatctgtctctaactcttgtctgtccagctccctcatacatgcaccctgtgattacgtggggcccacccagataatcctggttgatcactcacaggttctaggaatgaggatatggacatctttgcggggctgtactccagcctgccacacttctgaaggcactcagtgcttagtgtgttttgggctctgtatcctgagacctcccacagcatgcaggcctgacacttgccgtgggtgtggaggtgtggaaagtggcacccaggacacatgcctgccctttggaatgggggcgtaagcagaccatagaaggggtgcactcccaggagatcatccaggttgtacccacattcgcccacactaaaggtgccccagagcatggcgatgaccagggacacagacccaccaccctcccacctgctctgtttacatcacctgccaggaggcttctgaagctgctgctgtttactcgtgtgtgtgtgttgtatcaaaattcacatcagaagtgtgctgagcaacaatttttaatcatttgacagaacagtgtcctcttctacttgttcacatgtttcataaatcattagagaagtgttctgtcctgcagtaaaatccaagcctcgtggccagtgacctcagtcctgcacagtgacaccccacaggcttctctgccccctcctggtttgcttcttcagttctgcttttcaccttcccttatttcctttgtttccttcattttcctcagaggctttttcagcgtgtgtgtgtgtgtgtgtgtgtgtgtgtgtgtgtatgttgtgttgtataattttgggcatcttttattaagtcttgaagcttttgaaaacctcttactattgattgattattcatggccctttaaacaatcatgaagggaagggaggcaagagaggccttgttcctcccttgaattctatgcggcttcttgcttaatatttatatccccctgaagtcagcattttagtaattcacattgagaatataattggaaacagtattttcattctccttaattacttgaagctgttccaggtgctctgtgtttattttctttactatgtttgtttgtttcagtcccaagaggaattacaagagtactgcagacatcatgaaatcacctatgtggcccttgtctcggataaagaaggaagccatgtcaaggtaaagacgtcagagattttttacaattcaatagttaggtgttacctgtggagcacctgccttcacactgaggcccgggccgtgtaggtgactggaaatccgttccctctactctccctttccattgttgggtttcttttttttttttgagacggagtctcgctgtctcccaggctggagtgcaatgacgcaatctcggctcactgcaagctccgcctcccgggttctcgccattttcctgcctcagcctccccggtagctgggactgcaggtgcccgccaccacgctcggctaattttttgtatttttagtggagacggggtttcaccatgttggccaggatggtctcctgacctcgtgatctgcccgcctcggcctcccaaagtgctgggattacaggggtcagccaccgcgcccggccgttgttgggtttcttgctgaagaaaatgtgtataaaataaggaagagagtccaccttcattaaagctttaaaaagcaaaacaaacaaaaaaactggctgtggttttttcctacttttctcctcttgttctctttttccagctaagaaaataagaataagtaaagttgtatctgctgataggcatatcctctcattgctttgtaaccaattttacttttttgtattcaactaaaagtgttcataaatataccacctcataacctttatttctaattatttttaaagggaaaaaaactttcttaaaaatatttttctcttctaatttttttttggtttcgatatcagggtaatgttggcctgatgaaatgagttggagagtgttctctcctcttctgttttctgtaagatactgtatacaattagtattagaagtccaatctcaaatatttctatatatagagctattctggttacctctttcttctagaggcagctttggtagtttatatctttcccggaacttttccatttcgtctgagttttcagatattcccctgttattgtttcactgtctctaggatctgcagtgatgctccctccttcagacctgatatgggtaatttgtgtcctccctcttttttgtctaatcagcctggctagagattgatcagttttgtctttccaaggaccagcttttggtgtcattgatttttctcagtttttatttgttcatgtgttttctattttattcatctccactcttatccattactattttcttccttctgcttattttggatttagtttattctttttttagtttcttcaggtagaactttagatgaggtattgacaaactacaccttggaccaaattcagcccatagcctgcttttatatgtctgtgaactagaaatttttacattctttgttaaaaaacaacaacaaacaaaggagagtgtgtgactccaactatgtatggccctcaaagcttaaaacatttcctatctggccctttacagaaaaaaatttgaagctttgttattatacatgtttaggattttatatcttcttgatgaattgtcttcatcattataaaatattccttatccctggtaatatttcttgttctgaaatcttttggttagtgtttacgtcactacctttctccatccttttatttttaacctgtcttttttttttaagagatgggggtctcatcatgttgcccaggctggccttgaacgcctgggctcaagcaatcttctcacctcagcctccagctgggatacaggcgtgtgccactgcacctggctaacttatctatctttatatttaaagtgagtttcttatacacagtcactaggttgagttttcctttttttttttttttttttttttgagatggattcttgctctgtcacgcaggctggagtgcagtggtgcaatctccacttgctgcaacctccacctcccaagttctcctacctcagcctcctgagtagctgggtttataggcacacaccaccacacccagctaatttttgtatttttagtagagacagggtttcaccatgttggtcaggctggtctcgagctcctgacctcatgatccacccacctcggctccccaaagtgctgggattagaggcgtgagccactgcgcccagcctcctttttttttttttactctgagaatcctggcttttttttgtttttttttttgagacagggtctcactcacctatgttggagtgcagtggcgcgatctcagcttactggaacctgtctcccaggatcaagtgatcctcccacctcagcctcccgagtagctgggactacaggcacgcaccaccatgactggctaatttttgtatttttagtagagacgaggtctctactaaatgccaaatgccatgagatttgctaaatgccatgagagtcctacagataaagttctccaagggtccctcaggctgggagatttacataagaggcagcagtgaagtcttcaggaaggtgctgggatttatcctaccctcaagaattcgtggtcctggaagggccttttaggaagagggaactgcaaaggtgatggtagttcttttagtagttgtcccaaagatagaggcaggccagcagagaaccattctggtacaaccctgaatagtctattttgggtgagacagatggatcagaagcagaaaatggttatagctacatcatggagagcccaaatgccaaccaaggaatctggtttttttatttagcagttattggggaggccccgaatgttttgaacagaaggagacatcaaagttgtgtttgagaaaaattaatctgcagggatgtgtagcatggaatagagtgagggagaaaccgaggacagtgatagcagtataaagaatatcaaactagcctaggccaaggttgggtgctggccaggggagtgaagatgaagggacagatgccataaaagtgggatgacaggacttgggtttagaaaggagagggaggagtggtagatgaagctgagatctgagaaaccttggtggctgaccagatttaaaggggaagatgttaaagaatcacatgaaatgagagcccattcatcttggccttaaaaaaaaaaaattctatcatctgtgataaactagtccagaccagggtttctcaacagcagcgctgttcacattttgggccaaataattctctgttgtagggggctgtcctgtgcattaacagcatctctgaccgctacctactacatgccagttgcaccatccaaaaatgtcaccagacattgctaaatgtcccctggggagcaaaattgaccctggttaagaaccactgacccaaactattgatttagtagtcttactgtggtgctctgagctagtcttctgggttcagaaacctccaaatgatagatccgtttcattctttttaaggttaagtctttcgagaaggaaaggcagacagagaagcgtgtgctggagactgaacttgtggaccatgtactgcagaaactgaggactaaagtcactgatgaaaggaatggcaggtaacttaggaaacaaaagccgagaaaagtgacttcagttacctatatggaaactacgtaaatttattttaaaagtcaatttgagccaggtgctgtggctcacacctgtaatcccagcactttgggaggccaagtttggggaatcacttgaggccaggaatgcaagaccagcctgggcaacataccaagaccccatttctaaaaaaaaaatttttttgattagctgggcatggtggtgcattcctatggtcccagctactcaggagctgaggtgggaggattgcttgagcccaggaggtcaaggctgcagtgagccatgttcataccactgcactccagcctgggtgaagagaaagaccctgtctaagaaaaacaaaaagaaagaaatcaatttgatccttttgagaaacaaagataggtcaggattacttttaatgaaccattctgttgcttctgaataactcaatcaggagtttaattgtatgaccatcttgtatgagactaatcatagcttacattcaacatttgttcttcataccatttccaagaatactttatcattttgaaaagcctcaggagccaaaatctatctgtcattatcttattcagtctgctaatcagtgaatttcaataatattttgtccgtgtactttgaaagatgtaacgttctgggaaaagatctcacttcctcatgatgggagtatcaaccatatgggtaggaatttgacaaagtaaattaaaagccttaaaactaaacattttttttaaattgacccagcaattccactttcaggaatttataataaaaattattttaaagatgtctatcaaggctcatttataacagcagttctcaaactttttggtcttagaacccctttacacccttaaaaattatttcaggatcccaaagaacttttgtttatgtgagttatatctataaatattaaaacataaacattttaaatatgtttattcatttaaaaataacaataaccccattacatgctaacgtaacatatttctattgaaaaacaactgttttccaaaagaaaattaacttagtaaggaaaatggcattgtttaaaatatttgcacatcttttagtacactgttttacatttttgtaatctattttaacactttagtagaagaaatgattctcctgtctgtttatgtattcaatctgttgtgataccacaaatcatatagtctctggaaaactcggttgcacatttatgagaggatgagagtgaaaaggcaattaatattttaagattattatgaaaatagttttgaccttgcaagaccccttgaaaggatatgagggaccttcaagattctctagaccacacttggagaacctcatttcaaaatatacattggtagaagattgtttgaattatgataatttggtgaaatattgtgcagcctttaaaaatgatgattctactaaagctgagttcattgacatggaaagatgtccataaataggatgtttaatataatcccattttgtggccgggcgtggtggctcacgcctgtaatcccagcactttgggaggccgagaaggggggatcatgaggtcaggagatcgagatcatcctggctaacacggtgaaaccccgtctctactaaagatacaaaaaaattagcggggcatggtggcgggcacctgtagtcccagctactcgggaggctgaggcaggagaatggcgtgaacccgggaggtggagcttgcagtgagtggagatcgtggactgcactccagcctgggtgacagagcgagactctgtctcaaaaaaaaaaacaaaaagaacaacaacaacaacgaatatataatcccattttgttttaaacaaaatatacaacctatacataaaaaaatgtctagaagaacgtaccaaatttttaattgtagttttggttagtgggattacaagggatcttaaattactttgttaagcttttctatatatttgcaactcctttttttttttttgagatagagtctcacttttgccgaggctgaagtgcagtggtgtatacatgactcactatagccttaacctcccaggctcaggtgatccttccttcttggcctcctgagtagctgggaccgtagtcatgtaccaccttgtccagctaatttttttaaattatttgtagagacaggatctccctatgttgcccaggctggtctccaactcctggactcaagcaactctcccgcctcaagaaattcttatatgtatgctcattatcagaaaataccacacggtaatttttctggcttacatcagcaattctcaaccaacaatgattttgcttcccagggcacatctggcaatgtatggagacatttttggttgtcacaactggggagttttactggtatctaggagaggccagggatactgtgaaaacatcctaaagggtacaggactactaccccccaacagagaattttctggcctaaaatttcagtagtaccaagattgggaaatcctggcttacagaaaacaaaccttgctctgttcttctcatgcccccaccccttcttatttgcacctagccttaataaattcaccattaggtgtttctgagggaacataatgttctggaaatcaccagtattggaattatagatctaaatcaaagacagaggtttagaagagaaaccaagaaatagccaagtagtgagtatgggggaacattaccaagacacttaaaaggctacatgggatttagttttagcagggaaaggttcaaagtttttcctccagcaaatgattatttccctgttttcccaagatagagtgctgttgtctctctcaaaggctataaattaattcacagcatttgaaagaacatccattcacggctttttaaagaatatctttatttaccaaatgttctcctgtgggtggttgccaaggctactgccataatgaaggtggggctgctgttattcatgtttccttgtattatgaggggggcggaaagaacacccattatatttcattgaaatcagcttattgtgtggatccaggatttcacgcccagctgaataaatcagaatgttttccttaggcatttgttaacttaaaaagacatcctttataatttttacttgctcttgaccaaagcataactaaatgcaaattttttgtttttgtttttccaccaataaccaagaagatgtttttatatttaatggaaaagtggctcactatacatgtagttcactgtaagttatgtgttgcttgtgccttattgactgttctttaattgtttttgtttgcttgtttttagagaagcttccgataatcttgcagtgcaaaatctgaaggggtcattttctaatgcttcaggtataattactaattataatctgaacataatgatgcttatatgtttgctctaagcacttattactgtagctaactgcttgtgacactggaaatctatttttaaaataacatatacgcaataaattgtaccacatgggatgcatccctatgctttgaaatccacatcctagaaaaggataaaacaactggaatttagctgactcttctactctatctcttatttttacaagtgatttaatcttccttttactcaatttattgtacaagtgaaatgtgtataattttcctggagattttcctcatacagaggattgaaggaagtattttgaaatcccttgaagaaggacactatacacattttgttttcgtgaaagccaagagggcacagtggtgatagttatgcctttgctttcatcacctctagcaaccttacttcttttttaaagaagtgttccaattaaggccatgagaagacatatttggcttttaacagaattgagtctttcccattctcttctgttagcactaactttgtgttgccatcagatttccaattcttgcaggaatttaaagaagtatgcaggtttggtgatattcagcttgattttcttaggcccctgaggttttgatgactcctgttgcctccctgccccttccaccaccccccaacccctgcctgaggagagaagcatcaaaactgctgggtgttggggttctgggctcctcacctatccggtgcagatggttgtagggatagaaaacacagcccagtcgtgatctagcccttagaatcacgacaggatgtctactaataaactctgccatctctctgtagtatgttgtagaaagtgggaccagataaggccataaattctgaaactctcttggtctcaggtttgtttgaaatccatggagcaacagtggttcccattgtgagtgtgctagccccggagaagctgtcagccagcactaggaggcgctatgaaactcaggtacactgggtcagggtttctttggctttctaatatgagttacagaagagaaaaacaacaacaggaaaggaaaataagataaacatggaatttcttggaaatattttttccaagaaaaaaatttttcttccaacttgcctaactgggtggcttctggctccaggattcccatctgtccttcagagaggggccattgtgcactgtgggcacctcaaggcagctgttgtcagagtgactgcatctaaatgaaaactatctaatctggctctaaaggtagttgaggtttgtttgtgctctaaatagcaaagtagaagaggccgatgacaagacttaaggcaggcttctcattccatacatggtttcggcatttgctatatgcctactggtgtgctaagggctgtgtaaaatgtagaaaacattaacatggccccagtcctcaaaagagtttataacttagaagcatatgcattatatagagaataataaaagcaaataaatataggccaggtgcggtggcttatgcctgtaatcccagcactttgggaggccgaggagggcggatcacttgaggtcaggagttcgagaccaccctggccaacatggtgaaaccctgtctctactaaaaatacaaaaattagccaagcgtggtggcaaacgcctgtaatcccagccactcgggaggctgagacaggagaattgcttgaactggggaggcagagattgcagtgagccaagatcatggcactacactacagcctgggcaacagagcaagactttgtctcaaaataaaataactacagtagaacactgagttaaatttatagaatatgaatgttagagtatgctgtggacatatgcaaaagagtgagtgttaaaagagagcagtcaattttagaaatgtaatcagactgaaatacaaaaatcaggtactttatttttgtaagctcttctagctgtttctcaggatttgggtggaaacctatttttcccgtcttcctactgccttcatcacctaccaagtttcagttctcacaccatgtcctcattgctgccacctctccctttttcccaatttagcttcatactatcatctctctgtctctgtgtgcactgtttcactgcgctacgcctttataaggaatcatttcaaaattatgaagagataattgacaaggattattaaacaaatggtcaagataagttataaaaacctcatttcccctgagatcatattgctagacacccctttctgagtggattaagagcaaatcttcttttttttttttgagacagagtctcactctgtcacccaggctggagtgcagtggtgcaacatcagctcaccacaacctctgcctcccatgttcaagcgattctcctgcctcagcctcccgaatagctagtattataagcgccggccaccatgccctgctaatttttctattttcagtagagacggggtttcaccatgttggccaagctggtctcaaactcctgacctcaggtgatcccccagccttggcctcccaaagtgctgggattacgggcatgagccatcgtacccagccaagggcaaacctttagacaccatttggaatcctttctaggctttggtatgtaaccctgtgattgtatcctgggataggaaataagatggcaagaaagatggcttggtttaacatgttctgaattccattttcttactatttaggtacaaactcgacttcagacctcccttgccaacttacatcagaaaagcagtgaaattgaaattctggctgtaagtggctttctttagtattttgaaggtggcttctgtccatactgtcaaagtagttgcctcagggttcagagcttttttgctcagtgtcagcagaatttggatgcaggccttattgtgatgtgaactacacgcaatttaaaactattaagaactagggggagaatttaaggttttttgtttctcctctttgttcctctttaagatagaggaaaatgaaaacaaaagtcattttcctacatatatcaggcctttgccttgctaagcttacaccgaatacatgtagcagcgtcagacctttcgggtgtggtgtagagggacagggagtacagtttccactgcttattaattctccagggctaagatcttatcactgcacagttcattaagcccttttacagcacaatagcatctcagactctgcaaaccctattcatactgctgcatttcacgtgacactatggtcacaaggcagtattgtgctgctgagagttgatgtacatttgtgtgtattcacaggtggatctacccaaagaaacaatattacagtttttatcattagaggtaagcaatatgaactcttctgcactgtggcctttaagatcccaaatctttgctattagtttgccaaaatactgaagacggcattcattagtgatagtatttttctggcagctgcaggaatttagtaacatttttccttttatgtaacatatatgttcctaaatcctatgttgaaggactcatacttttctagtgactttatttttcagatacttattttattaaaaacaaaaaacaaaaacaaaaaaacacatatactgcttttactatgtgtcagggtctggcaggccttgttgtaagcattttacaagtagtaactcatttaatcattaccaccccaaaatgtagatactgttattatccctttacagagtacggaagtagagaggttaaatatcttacccacagtcacccagctagtaagtagtagaaccaggatttgaacctaagcagactagcagaatcggtgttcttaaccactatactatactatctctcaaacctccattccagctagggaagctcatttgcagattagtactatacaaaacaaaatccttttgtaaaaattaattaggtcctttataaatatatatatatttttacaggtacatccctttatcatcaaatagcctaaataagaactttaaaaatttgaatagttatctttgctattaagaacactcaactatagtcatagctacaggtgacttttgcaacatgtcatatcaaagaatacttttttgtctatccagagtgtttagtcacaaattaaattagattaatagtgaacttagccctagaactagtattttatatatcattttttgttctcttacaaataagcatataccactatctcactggcagtgtactgatttatgatccagtcaaatggatatacttaagagctgctatcaccgttgtacaaaaagtaaacagaggccgggtgcagtggctcacgcctgtaatcccagcactttgggaggccgacgtgggtggatcacctgaggtctggggtttgagaccagcctggccaacatggtgaaaccccatctctactaaaaatacaaaaaattagccgggcgtagtggcaggcgcctgtaatcccagctacttgggaggctgaggcagaagaattacttgaacccaggaggtggaggttgcagtgagccgagattgtgccactgcactccagcctgggcaacaagaccgaaactccatctcaaaaaaaaaaaaaaaaaaagtaaacggtaggcagaaataactgctctaaagtcacatcagcacactagggctgcagcattgttaatcaggctctaattagggagtcttgttttaaggaaaactggtgcttcagaggaaccccagcagtctcctaactggttctgctatctccctattactgattctcctggtatacttgaagagggaaatgacactggaatttcattagtgacccagaaaaaaccagctagtaaaccctagagacctgttgttaagtcttatctatttttttcctagtgggatgctgatgaacaggcatttaacacaactgtgaagcagctgctgtcacgcctgccaaagcaaagatacctcaaattagtctgtgatgaaatttataacatcaaagtagaaaaaaagtaagttatcacttgggcatagcagggttcacatggttaaaattcagggcggggggtttcagagtgacattattttgttgtcttgttgaggtttgacgcctggtaagctgttcttagaattgcagctgacaaccaataaatcttgcttggactgtgaatcacagtcatgatctcatcaataacaaaacacaggggtcctaggagtagctgtcccaattacaattttgttcacccaggtaattcactttctaagtatgtttaaatcaaagaaaataaccatgactactttgctgtatgtccttatgtcataatgccaatcaatcaatcaatcattcatgttatcatacacttaaaaggcaacaaggaagcctatgaggtgaatggttatctccttactaggaccttatactgcagacccctgtcagtcacaccttgtataaaacctatataattttttaatgactagccttccatcttgtttttgcttaaataaagctcctacaggtgttataaaaatttattagctctgttcttcactcattaaactgagtctgtccttatatcttttcttttcttttgcagggtgtctgtgctatttctgtacagctatagagatgactactacagaatcttattttaaccctaaagaactgtcgttaacctcattcaaacagacagaggcttatactggaataatggaatgttgtacattcatcataatttaaaattaaattctaagaagaggctgggtgcagtggctcacacctttaatcccagcactttgggaagccaaggcaggaagactgcttgaaaccaggagtttgagaccagcctgagcaacaaagcaagaccccatctctataaaaactaaaaaaattagttgggcatggtggcacatgcctgtagtcccagctactccagaggctgagatggatcatctgagcctcaggaggttgaggctgcagtgagctgtgactgcgccactgcactccagtctgggacaacagagcaagaccctgtcttaaaaaaaaaaagaaaaaaaaaatttttttctaagaagctgtcctacaaagttgagctttgttagtttttcatgtgtaatatattataaatttatcttttgggatataataaatgctttcatatacctgctgctttttaattgtaaatctattaacactaaaggttttagggagctggaacataaggtaaatagccttttcttcccttggctgtaatgactaagcacatgaaaatatccaaaccaaagggcataaagaaaccaaaaatcataattactttggaacctttattcttgatgactttgtagtatgtttctcctaaggtggttaaacaaactctcatttgactgtgagaactcatcgaaactggggaaccatgatgataaaattatacagccaggtgggaagcagctcatgagataacatgactttttataaaactgtcaggtttcaattctaataacctagaagatattatagagctaaagcctattcattaatcacatcattctagatttagtagttattgccagaactattaaaatgggttgggaaaggaataaagagacagtgctgataaacagacatgtttaatgatagcttgctcttcacagagatgtctacagagacttttaatctataatccaggagtatataaccatgcagcacagaccaattagccaaatgcaaaataaactagattcttaccacaactatcctataaacactgcaactattctttccaaaaggaccctaatcttatgtgaaaacacctactgtgggggaaccagaaacctagctatctggccaaaaggaaaaaatagcaattcagtggttaattggtgaaagcaggaaatgtatgccctttactgtgctgctgttgctgctgttgttgctgctgttgttggtgctgttgctgctgcggcaggtgctgctgctgctgctgctgctgctgctttggtcttcttagttttgttctttttgtctctcttcttcagcccatccatgttagctctaaggaggtttgaataagcctgaaagatacaacagagcataccttagtgggaagatgtgcaaactggcagaacaccagccctatctgcataatggatttagggtagccaaaaatcaggaaagaatatagcaccattggacacttgtaccggaaaatggtataagcataaaacactctttcacattatagcagcttctgcaacacccacagacagttgcacacattttttacgtttttttccaagggaaaattgcaggcaacttcttgttcaactatagtataggtagcatatatctacagcctaagacaaaatctaacttaaaaaaactagaaaggaagacggtattagcattgaaattcacaccctggcagcttttacttgaaacatactggtaaaacttatctccggagagcagtgaacccaagtatcaatcttacccagtgttcactatcatactgactcttgccctgagaagggaaacataaggaacacccaaaactcaccatctgaaacttattcacttccttggagctcacctgaaaaagaaggaaaaaagaggtcatacctattatccatataagcatcctcttctccaccccagatagtatctcaaaagcctccggaagacaatatccttatctttaaaatacttctccccaacttcagggttcataatacacgaatggttatttttctactctactttcctctgcctagagaacaagaaaaggagctctgcatctttttccacatgagaattgcaccaagaggtgaaaggcagtaggctccttttggggaaaaaaaaaaaaaaagctttgtttctcacctcttgaaatcccttagaaaggtggcattgggttttctccctgggttctgagaaaagtcagaggacttctcagtattaattttttatacattaatagaagatatatttaaactactccctccccatcttatttttaaacctgccttccattaattcaagcatatttaagcacaatgcgagctaccacaaaataaattctacctctgaagaacactccttaggtttttgttatttcatgatatctaacttaatctgtaaaaccacataagcttgttttactgtagaagt

SEQ ID NO: 84 - DNA, 1967 bp, Homo sapiens
tagagatcctggcgccgagcgacaggtgccggaacaaacaggcgatgagaaatcgcggacgcggaaccatttcttgggcaggacttccggcggaaaagcgggctgtctcggaaactcagagccgggttcctcccgggtttctgccgggtttctccctgcggctcctgggttgttgagactcttgtgaagatggcttgcgctgccgcgcggtccccggccgaccaggacaggtttatttgtatctatcctgcttatttaaataataagaagaccatcgcagagggaaggcgaatccccataagtaaggctgttgaaaatcctacagctacagagattcaagatgtatgttcagcagttggacttaacgtatttcttgagaaaaataaaatgtactctagagaatggaatcgtgatgtccaatacagaggcagagtccgggtccagctcaaacaggaagatgggagcctctgccttgtacagttcccatcacgttaagaatgtctgaggggtcaggcggtgctggcaagatggctgcacttgagaagatgacgtttcccaagaagatgacatttccagagaaaccaagccacaaaaagtacagggccgccctgaagaaggagaaacgaaagaaacgtcggcaggaacttgctcgactgagagactcaggactctcacaggaggaggaagaggacacttttattgaagaacaacaactagaagaagagaagctattggaaagagagagggaaagattacatgaggagtggttgctgagggagcagaaggcacaagaagaattcagaataaagaaggaaaaggaagaggcggctaaaaaatggctagaagaacaagagagaaagttaaaggaacaatggaaagaacagcagaggaaagagagagaagaggaggagcagaaacaacaggagaagaaagaaaaagaggaagctgtgcagaagatgctggatcaggctgaaaatgatttagaaaatagtaccacatggcaaaacccagaaccacccgtggatttcagagtaatggagaaggatcgagctaattgtcccttctacagtaaaacaggagcttgcagatttggagacagatgttcacgtaaacataatttcccaacatctagtcctacccttcttattaagagcatgtttacaacgtttggaatggagcagtgcaggagggatgactatgaccctgacgcaagcctggagtacagcgaggaagaaacctaccaacagttcctagatttctatgaggatgtgttgcccgagttcaagaacgtggggaaagtgattcagttcaaggtcagctgcaatttggaacctcacctgaggggcaatgtatatgttcagtaccagtcggaagaagaatgccaagcagccctttctctgtttaacggacgatggtatgcaggacgacagctgcaatgtgaattctgcccagtgacccggtggaaaatggcgatttgtggtttatttgaaatacaacaatgtccaagaggaaaacactgcaactttcttcatgtgttcagaaatcccaacaatgaattctgggaagctaatagagacatctacttgtcttcagatcagactggctcctcctttggcaagaactccgagaggagggagaagatgggccaccacgaccactactacagcaggcagcggggaaggagaaaccctagtccagaccacacctacaaaagaaatggggaatccgagagaaaaaagagtagtcatagggggaagaaatctcacaaacgcacatcaaagagtcgggagaggcacaattcaccaagcagaggaagaaataggcaccgcagctgggaccagggccgccggagccagagccgcaggagccaccgcagccggagccaaagttcctctaggtgccgaagtcgtgggaggaggaagtcgggtaatagagacagaactgttcagagtccccaatccaaataa

SEQ ID NO: 85 - DNA, 1475 bp, Homo sapiens
tttctaggaaggagccgagttattatctgcctctccgataggatgcctctttgtcttcacctgccattcccgctgtttcgtgaagaatcctctgtaaagggaaatttgttcaggcgactgctgtggccaccctctgcctcctccggcctctgcccctgggaggtccccgggggcctgggagtgtcattggcgtatgaccgcaacccttgccgctgccgctgacatcgctaccatggtctccggcagcagcggcctcgccgccgcccgtctcctgtcgcgcagcttcctcctgccgcagaatggaattcggcattgttcctacacagcttctcggcaacatctctatgttgataaaaatacaaagattatttgccagggtttcactggcaaacagggcacctttcacagccagcaggcattggaatatggcaccaaactcgttggaggaaccactccagggaaaggaggccagacacatctgggcttacctgtctttaatactgtgaaggaggccaaagaacagacaggagcaacggcttctgtcatttatgttcctccgccttttgctgctgctgccattaatgaagctattgaggcagaaattcccttggttgtgtgtatcactgaaggaattccccagcaggacatggtacgagtcaagcacaaactgctgcgccaggaaaagacaaggctaattgggcccaactgccctggagtcatcaatcctggagaatgtaaaattggcatcatgcctggccatattcacaaaaaaggaaggattggcattgtgtccagatctggcaccctgacttatgaagcagttcaccaaacaacgcaagttggattggggcagtctttgtgcgttggcattggaggtgatccttttaatggaacagattttattgactgcctcgaaatctttttgaacgattctgccacagaaggcatcatattgattggtgaaattggtggtaatgcagaagagaatgctgcagaatttttgaagcaacataattcaggtccaaattccaagcctgtagtgtccttcattgctggtttaactgctcctcctgggagaagaatgggtcatgccggggcaattattgctggaggaaaaggtggagctaaagagaagatctctgcccttcagagtgcaggagttgtggtcagtatgtctcctgcacagctgggaaccacgatctacaaggaatttgaaaagaggaagatgctatgaaagaaaaaaaaaattcctaaaactgtggaatggatcacgtagacatgtaacccagcagcagtttgcttctgttgtccactgattaatcagcctatgtgcctgacactggtcttgcagtacaactggaagccaaaacaaggtggaagatgtcctgaattaagatgttttcaccacattgtattacagagacagccaataaatctactatttgatttcaatatggaaaaaaaaaaaaaaaaaa

SEQ ID NO: 86 - DNA, 1319 bp, Homo sapiens
cgcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttcaaaaaaaaaaaaaaaaaaaaaaaaaaaaaaaaaaaaaaaaaaaaaaaaaaaaaaaaaaaaaaaaaaaaaaaaaaaaa

SEQ ID NO: 87 - DNA, 1686 bp, Homo sapiens
cagacgctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaaaaaaaaaaaa

SEQ ID NO: 88 - DNA, 771 bp, Homo sapiens
atctgagcatgtgttcgcgaccacgatgagtgtgccgcacttccggccagatcgccggatttccgctgagtgacccttacaagtccttcttgatcctgaactgggttaggtgccgctgttgctgctcgtgttgaatctagaaccgtagccagacatgggactggaggacgagcaaaagatgcttaccgaatccggagatcctgaggaggaggaagaggaagaggaggaattagtgataggactgaggctttcagtgcatactggcaaccttggaaggcaggaatgtgaaacttttccctactacttagcatcagaattgaatgggagaccgcattctgccatttctggcggcagtgtggctctgccagctggccttctgcacggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaac

SEQ ID NO: 89 - DNA, 3636 bp, Homo sapiens
gtgcagaaggccgcgctagccggctcttcagcagcgagtgcagattgctcccccgcggccgcagatctcccgtttgcgccgcgttcagctgctcccgaacaacttttctgccggcccagaggccccagggcgtcgcagcgccgcgtgcggcccactcacgggccggatggactccaacactgctccgctgggcccctcctgcccacagcccccgccagcaccgcagccccaggcgcgttcccgactcaatgccacagcctcgttggagcaggagaggagcgaaaggccccgagcacccggaccccaggctggccctggccctggtgttagagacgcagcggcccccgctgaaccccaggcccagcataccaggagccgggaaagagcagacggcaccgggcctacaaagggagacatggaaatcccctttgaagaagtcctggagagggccaaggccggggaccccaaggcacagactgaggtggggaagcactacctgcagttggccggcgacacggatgaagaactcaacagctgcaccgctgtggactggctggtcctcgccgcgaagcagggccgtcgcgaggctgtgaagctgcttcgccggtgcttggcggacagaagaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagtccctgcagaagcagaggcgcatgctggagcgcctggtcagcagcgagtccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcgtcagcaacctcaccatcgacttcttcgccttcttcatcccgctggtcatcttctacctgtccttcatctccatggtgatctgcaccctcaaggtgttccaggacagcaaggcctgggagaacttccgcaccctcaccgacctgctgctgcgcttcgagcccaacctggatgtggagcaggccgaggtcaacttcggctggaaccacctggagccctatgcccatttcctgctctctgtcttcttcgtcatcttctccttccccatcgccagcaaggactgcatcccctgctcggagctggctgtcatcaccggcttctttaccgtgaccagctacctgagcctgagcacccatgcagagccctacacgcgcagggccctggccaccgaggtcaccgccggcctgctatcgctgctgccctccatgcccttgaattggccctacctgaaggtccttggccagaccttcatcaccgtgcctgtcggccacctggtcgtcctcaacgtcagcgtcccgtgcctgctctatgtctacctgctctatctcttcttccgcatggcacagctgaggaatttcaagggcacctactgctaccttgtgccctacctggtgtgcttcatgtggtgtgagctctccgtggtcatcctgctggagtccaccggcctggggctgctccgcgcctccatcggctacttcctcttcctctttgccctccccatcctggtggccggcctggccctggtgggcgtgctgcagttcgcccggtggttcacgtctctggagctcaccaagatcgcagtcaccgtggcggtctgtagtgtgcccctgctgttgcgctggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaagagcgtgctgctcagcctgcgccagggcagcctcatcgagttcagcaccatcctggagggccgcctgggcagcaagtggcctgtcttcgagctcaaggccatcagctgcctcaactgcatggcccagctctcacccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcctttccccagtgtggccccagcccgacaggcatgcaccagtgccgcctgtgcccacgtgtgcagactgtggctgcagagaccttgcgaccatgtgtagattgcgtggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctccacagtagcatttcttatttgtttggtcactgctacaccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctgtccagcaggtagtgggtgaatgtgtgaaggtcttgcctgaatccatcaggacttgggaaacagagaaccctgtgggggcggctgtgggggaggtccctgccagtgtttagaagagcctgactgtgttcagtgccttggagcagaaagccagggtcctgagtggctgaaataaaagcctctggtggaacctgca

SEQ ID NO: 90 - DNA, 1820 bp, Homo sapiens
ggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

The invention claimed is:

1. A method of systemic delivery of a polypeptide to a subject comprising genetically modifying target skin cells within skin of a subject comprising
    administering to the subject an engineered virus comprising one or more foreign nucleic acid sequences encoding one or more target polypeptides, wherein the engineered virus is an adeno-associated viral vector,
    wherein the one or more foreign nucleic acid sequences of the engineered virus are introduced into the target skin cells within the skin to produce genetically modified skin cells, and wherein the genetically modified skin cells produce the one or more target polypeptides by expression of the one or more foreign nucleic acid sequences, and
    wherein the one or more target polypeptides are excreted from the genetically modified skin cells and are introduced systemically within the subject.

2. The method of claim 1 wherein the administering the engineered virus comprises topically applying a formulation comprising the engineered virus to skin of the subject.

3. The method of claim 1 wherein the genetically modified skin cells are long-lived and non-replicating.

4. The method of claim 1 wherein the polypeptide is a therapeutic agent.

5. The method of claim 1 wherein the engineered virus is a genetically modified virus.

6. The method of claim 1 wherein the engineered virus is a non-integrative viral vector.

7. The method of claim 1 wherein the one or more target polypeptides is an antibody or nanobody.

8. The method of claim 1 wherein the genetically modified skin cells produce the one or more target polypeptides over a sustained period of time.

9. The method of claim 1 wherein the genetically modified skin cells produce the one or more target polypeptides over a sustained period of time to provide immunity against a target disease.

10. The method of claim 1 wherein the genetically modified skin cells produce the one or more target polypeptides over a sustained period of time to provide immunity against one or more target antigens.

11. The method of claim 1 wherein the one or more target polypeptides are introduced systemically within the subject by introduction into a circulatory system of the subject.

12. The method of claim 1 wherein the subject is a mammal.

13. The method of claim 1 wherein the subject is a human.

14. The method of claim 1 wherein the skin cells are human skin cells.

15. The method of claim 1 wherein the one or more target polypeptides include a neutralizing antibody against HIV-1.

16. The method of claim 1 wherein the one or more target polypeptides include a broadly neutralizing antibody against HIV-1.

17. The method of claim 1 wherein the one or more target polypeptides include a fibroblast-facilitated neutralizing antibody against HIV-1.

18. The method of claim 1 wherein the one or more target polypeptides include a camelid nanobody.

19. The method of claim 1 wherein the skin is treated to be permeabilized to the engineered virus.

20. The method of claim 1 wherein stratum corneum of the skin is processed to be permeabilized to the engineered virus.

21. The method of claim 1 wherein the skin is pretreated with cavitational ultrasound or microdermabrasion to disrupt the cutaneous stratum corneum, and wherein the engineered virus is transported to the epidermis, the papillary and reticulous dermis.

22. The method of claim 1 wherein the skin cells are dermal fibroblast cells or epidermal progenitor cells.

23. The method of claim 1 wherein the skin is treated with ultrasound prior to administering the recombinant virus.

24. The method of claim 1 wherein the skin is treated with ultrasound prior to administering the recombinant virus and ultrasound is stopped prior to administering the recombinant virus.

25. The method of claim 1 wherein the skin is treated with ultrasound at a frequency between about 20 kHz and about 100 kHz.

26. The method of claim 1 the skin is treated with ultrasound applied at an intensity between about 1 $W/cm^2$ and about 10 $W/cm^2$.

27. The method of claim 1 wherein the skin is treated with ultrasound applied for a duration between about one minute to about 10 minutes.

28. The method of claim 1 wherein the skin is treated with ultrasound applied at duty cycles in the range of between 25% and 100%.

29. The method of claim 1 wherein the skin is treated with ultrasound applied topically or intra-dermally.

30. The method of claim 1 wherein the engineered virus is a recombinant AAV of serotype 1, 2, 3, 4, 5, 6, 6.2, 7, 8 or 9.

31. The method of claim 1 wherein the one or more target polypeptides comprises a cytokine including an IFN-g or a FGF21.

32. The method of claim 1 wherein the one or more target polypeptides comprises IL-1Ra, HGH, IFN-a, Erythropoietin, Interleukin-2, Factor VIII, or Factor IX.

33. The method of claim 1 wherein the one or more target polypeptides can be a therapy for psoriasis and comprises antibodies against TNFa, IL-12/23, IL-17, or CTLA4-Ig.

34. The method of claim 1 wherein the one or more target polypeptides comprising IFN-g which acts as an immune-modulating agent against viral infections, dermatitis, and supplemental agent to cancer treatments.

\* \* \* \* \*